(12) United States Patent
Schebye et al.

(10) Patent No.: US 12,129,297 B2
(45) Date of Patent: Oct. 29, 2024

(54) ANTIBODIES AGAINST TIM3 AND USES THEREOF

(71) Applicant: Bristol-Myers Squibb Company, Princeton, NJ (US)

(72) Inventors: Xiao Min Schebye, San Carlos, CA (US); Mark J. Selby, San Francisco, CA (US); Michelle Minhua Han, Piedmont, CA (US); Christine Bee, San Francisco, CA (US); Andy X. Deng, San Mateo, CA (US); Anan Chuntharapai, Daly City, CA (US); Brigitte Devaux, Palo Alto, CA (US); Huiming Li, Lexington, MA (US); Paul O. Sheppard, Granite Falls, WA (US); Alan J. Korman, Piedmont, CA (US); Daniel F. Ardourel, Woodinville, WA (US); Ekaterina Deyanova, Lawrenceville, NJ (US); Richard Yu-Cheng Huang, Bridgewater, NJ (US); Guodong Chen, East Brunswick, NJ (US); Michelle Kuhne, San Francisco, CA (US); Hong-An Truong, San Francisco, CA (US)

(73) Assignee: Bristol-Myers Squibb Company, Princeton, NJ (US)

( * ) Notice: Subject to any disclaimer, the term of this patent is extended or adjusted under 35 U.S.C. 154(b) by 362 days.

(21) Appl. No.: 16/961,545

(22) PCT Filed: Jan. 11, 2019

(86) PCT No.: PCT/US2019/013246
§ 371 (c)(1),
(2) Date: Jul. 10, 2020

(87) PCT Pub. No.: WO2019/140229
PCT Pub. Date: Jul. 18, 2019

(65) Prior Publication Data
US 2022/0089720 A1    Mar. 24, 2022

Related U.S. Application Data

(60) Provisional application No. 62/616,723, filed on Jan. 12, 2018.

(51) Int. Cl.
| | |
|---|---|
| *C07K 16/28* | (2006.01) |
| *A61P 35/00* | (2006.01) |
| *G01N 33/68* | (2006.01) |
| *A61K 39/00* | (2006.01) |

(52) U.S. Cl.
CPC .......... *C07K 16/2803* (2013.01); *A61P 35/00* (2018.01); *G01N 33/6854* (2013.01); *A61K 2039/507* (2013.01); *C07K 2317/21* (2013.01); *C07K 2317/31* (2013.01); *C07K 2317/34* (2013.01); *C07K 2317/74* (2013.01); *C07K 2317/76* (2013.01); *C07K 2317/92* (2013.01); *G01N 2333/70503* (2013.01)

(58) Field of Classification Search
CPC .......................... C07K 16/00; A61K 39/39541
See application file for complete search history.

(56) References Cited

U.S. PATENT DOCUMENTS

| | | | |
|---|---|---|---|
| 4,399,216 A | 8/1983 | Axel et al. |
| 4,439,196 A | 3/1984 | Takeru |
| 4,447,224 A | 5/1984 | Decant et al. |
| 4,447,233 A | 5/1984 | Mayfield |
| 4,475,196 A | 10/1984 | La Zor |
| 4,486,194 A | 12/1984 | Ferrara |
| 4,487,603 A | 12/1984 | Harris |
| 4,522,811 A | 6/1985 | Eppstein et al. |
| 4,596,556 A | 6/1986 | Morrow et al. |
| 4,634,665 A | 1/1987 | Axel et al. |
| 4,683,195 A | 7/1987 | Mullis et al. |
| 4,790,824 A | 12/1988 | Morrow et al. |
| 4,816,567 A | 3/1989 | Cabilly et al. |
| 4,881,175 A | 11/1989 | Ladner et al. |
| 4,941,880 A | 7/1990 | Burns |

(Continued)

FOREIGN PATENT DOCUMENTS

| | | |
|---|---|---|
| EP | 0154316 A2 | 9/1985 |
| EP | 0338841 A1 | 10/1989 |

(Continued)

OTHER PUBLICATIONS

Rudikoff et al. (Proceedings of the National Academy of Sciences USA, vol. 79, p. 1979-1983, 1982) (Year: 1982).*

(Continued)

*Primary Examiner* — Michael Allen
(74) *Attorney, Agent, or Firm* — Sterne, Kessler, Goldstein & Fox P.L.L.C.

(57) ABSTRACT

Provided herein are antibodies, or antigen binding portions thereof, that bind to T-cell immunoglobulin and mucin-domain containing-3 (TIM3) protein. Also provided are uses of these antibodies, or antigen binding portions thereof, in therapeutic applications, such as treatment of cancer. Further provided are cells that produce the antibodies, or antigen binding portions thereof, polynucleotides encoding the heavy and/or light chain regions of the antibodies, or antigen binding portions thereof, and vectors comprising the polynucleotides encoding the heavy and/or light chain regions of the antibodies, or antigen binding portions thereof.

10 Claims, 94 Drawing Sheets
Specification includes a Sequence Listing.

(56) References Cited

U.S. PATENT DOCUMENTS

| | | |
|---|---|---|
| 4,946,778 A | 8/1990 | Ladner et al. |
| 5,013,653 A | 5/1991 | Huston et al. |
| 5,064,413 A | 11/1991 | McKinnon et al. |
| 5,091,513 A | 2/1992 | Huston et al. |
| 5,132,405 A | 7/1992 | Huston et al. |
| 5,179,017 A | 1/1993 | Axel et al. |
| 5,223,409 A | 6/1993 | Ladner et al. |
| 5,225,539 A | 7/1993 | Winter |
| 5,258,498 A | 11/1993 | Huston et al. |
| 5,260,203 A | 11/1993 | Ladner et al. |
| 5,312,335 A | 5/1994 | McKinnon et al. |
| 5,374,548 A | 12/1994 | Caras |
| 5,383,851 A | 1/1995 | McKinnon et al. |
| 5,399,163 A | 3/1995 | Peterson et al. |
| 5,399,331 A | 3/1995 | Loughrey et al. |
| 5,403,484 A | 4/1995 | Ladner et al. |
| 5,416,016 A | 5/1995 | Low et al. |
| 5,427,908 A | 6/1995 | Dower et al. |
| 5,455,030 A | 10/1995 | Ladner et al. |
| 5,476,786 A | 12/1995 | Huston et al. |
| 5,476,996 A | 12/1995 | Wilson et al. |
| 5,482,858 A | 1/1996 | Huston et al. |
| 5,530,101 A | 6/1996 | Queen et al. |
| 5,545,806 A | 8/1996 | Lonberg et al. |
| 5,545,807 A | 8/1996 | Surani et al. |
| 5,569,825 A | 10/1996 | Lonberg et al. |
| 5,571,698 A | 11/1996 | Lander et al. |
| 5,580,717 A | 12/1996 | Dower et al. |
| 5,585,089 A | 12/1996 | Queen et al. |
| 5,624,821 A | 4/1997 | Winter et al. |
| 5,625,126 A | 4/1997 | Lonberg et al. |
| 5,633,425 A | 5/1997 | Lonberg et al. |
| 5,648,260 A | 7/1997 | Winter et al. |
| 5,661,016 A | 8/1997 | Lonberg et al. |
| 5,677,425 A | 10/1997 | Bodmer et al. |
| 5,693,762 A | 12/1997 | Queen et al. |
| 5,698,767 A | 12/1997 | Wilson et al. |
| 5,714,350 A | 2/1998 | Co et al. |
| 5,770,429 A | 6/1998 | Lonberg et al. |
| 5,789,650 A | 8/1998 | Lonberg et al. |
| 5,811,097 A | 9/1998 | Allison et al. |
| 5,814,318 A | 9/1998 | Lonberg et al. |
| 5,837,243 A | 11/1998 | Deo et al. |
| 5,874,299 A | 2/1999 | Lonberg et al. |
| 5,877,397 A | 3/1999 | Lonberg et al. |
| 5,885,793 A | 3/1999 | Griffiths et al. |
| 5,896,046 A | 4/1999 | Bjorksten et al. |
| 5,922,845 A | 7/1999 | Deo et al. |
| 5,939,598 A | 8/1999 | Kucherlapati et al. |
| 5,969,108 A | 10/1999 | Mccafferty et al. |
| 6,075,181 A | 6/2000 | Kucherlapati et al. |
| 6,114,598 A | 9/2000 | Kucherlapati et al. |
| 6,121,022 A | 9/2000 | Presta et al. |
| 6,150,584 A | 11/2000 | Kucherlapati et al. |
| 6,162,963 A | 12/2000 | Kucherlapati et al. |
| 6,165,745 A | 12/2000 | Ward et al. |
| 6,172,197 B1 | 1/2001 | McCafferty et al. |
| 6,180,370 B1 | 1/2001 | Queen et al. |
| 6,194,551 B1 | 2/2001 | Idusogie et al. |
| 6,207,156 B1 | 3/2001 | Kuchroo et al. |
| 6,277,375 B1 | 8/2001 | Ward |
| 6,350,861 B1 | 2/2002 | Co et al. |
| 6,437,095 B1 | 8/2002 | Lilie et al. |
| 6,521,404 B1 | 2/2003 | Griffiths et al. |
| 6,544,731 B1 | 4/2003 | Griffiths et al. |
| 6,555,313 B1 | 4/2003 | Griffiths et al. |
| 6,582,915 B1 | 6/2003 | Griffiths et al. |
| 6,593,081 B1 | 7/2003 | Griffiths et al. |
| 6,737,056 B1 | 5/2004 | Presta |
| 6,989,452 B2 | 1/2006 | Ng et al. |
| 7,087,600 B2 | 8/2006 | Ng et al. |
| 7,129,261 B2 | 10/2006 | Ng et al. |
| 7,317,091 B2 | 1/2008 | Lazar et al. |
| 7,635,757 B2 | 12/2009 | Freeman et al. |
| 7,943,743 B2 | 5/2011 | Korman et al. |
| 8,101,720 B2 | 1/2012 | Lazar et al. |
| 8,217,149 B2 | 7/2012 | Irving et al. |
| 9,334,331 B2 | 5/2016 | Igawa et al. |
| 10,421,807 B2 | 9/2019 | Gonzales et al. |
| 2003/0153043 A1 | 8/2003 | Carr et al. |
| 2004/0014194 A1 | 1/2004 | Beyer et al. |
| 2006/0004081 A1 | 1/2006 | Chen et al. |
| 2006/0024317 A1 | 2/2006 | Boyd et al. |
| 2006/0247295 A1 | 11/2006 | Gangwar et al. |
| 2009/0317368 A1 | 12/2009 | Chen |
| 2010/0069614 A1 | 3/2010 | Houtzager et al. |
| 2011/0007023 A1 | 1/2011 | Abrahamsson et al. |
| 2011/0150892 A1 | 6/2011 | Thudium et al. |
| 2012/0070861 A1 | 3/2012 | MacDonald et al. |
| 2012/0073004 A1 | 3/2012 | MacDonald et al. |
| 2012/0189617 A1 | 7/2012 | Takayanagi et al. |
| 2015/0218274 A1* | 8/2015 | Sabatos-Peyton ............ C07K 16/2803 435/254.2 |
| 2021/0171629 A1 | 6/2021 | Klippel et al. |
| 2021/0363242 A1 | 11/2021 | Schebye et al. |
| 2022/0089720 A1 | 3/2022 | Schebye et al. |
| 2022/0281997 A1* | 9/2022 | Qin ........................ C12N 15/85 |

FOREIGN PATENT DOCUMENTS

| | | |
|---|---|---|
| EP | 0401384 A1 | 12/1990 |
| EP | 1176195 A1 | 1/2002 |
| EP | 2535355 A2 | 12/2012 |
| JP | 2006517581 A | 7/2006 |
| JP | 2008278814 A | 11/2008 |
| JP | 2017511687 A | 4/2017 |
| JP | 2017523771 A | 8/2017 |
| JP | 2017536111 A | 12/2017 |
| WO | WO-8704462 A1 | 7/1987 |
| WO | WO-8901036 A1 | 2/1989 |
| WO | WO-9203918 A1 | 3/1992 |
| WO | WO-9312227 A1 | 6/1993 |
| WO | WO-9425585 A1 | 11/1994 |
| WO | WO-9429351 A2 | 12/1994 |
| WO | WO-9517886 A1 | 7/1995 |
| WO | WO-9632478 A1 | 10/1996 |
| WO | WO-9713852 A1 | 4/1997 |
| WO | WO-9734631 A1 | 9/1997 |
| WO | WO-9824884 A1 | 6/1998 |
| WO | WO-9842752 A1 | 10/1998 |
| WO | WO-9954342 A1 | 10/1999 |
| WO | WO-0037504 A2 | 6/2000 |
| WO | WO-0042072 A2 | 7/2000 |
| WO | WO-0045962 A2 | 8/2000 |
| WO | WO-0114424 A2 | 3/2001 |
| WO | WO-0158957 A2 | 8/2001 |
| WO | WO-0206919 A2 | 1/2002 |
| WO | WO-0243478 A2 | 6/2002 |
| WO | WO-03074679 A2 | 9/2002 |
| WO | WO-02092780 A2 | 11/2002 |
| WO | WO-02096910 A1 | 12/2002 |
| WO | WO-03035835 A2 | 5/2003 |
| WO | WO-03099196 A2 | 12/2003 |
| WO | WO-2004001675 A2 | 12/2003 |
| WO | WO-2004029207 A2 | 4/2004 |
| WO | WO-2004035752 A2 | 4/2004 |
| WO | WO-2004063351 A2 | 7/2004 |
| WO | WO-2004074455 A2 | 9/2004 |
| WO | WO-2004099249 A2 | 11/2004 |
| WO | WO-2005040217 A2 | 5/2005 |
| WO | WO-2005044853 A2 | 5/2005 |
| WO | WO-2005070963 A1 | 8/2005 |
| WO | WO-2005092925 A2 | 10/2005 |
| WO | WO-2006020114 A2 | 2/2006 |
| WO | WO-2006029879 A2 | 3/2006 |
| WO | WO-2006105021 A2 | 10/2006 |
| WO | WO-2006121168 A1 | 11/2006 |
| WO | WO-2006122150 A1 | 11/2006 |
| WO | WO-2007005874 A2 | 1/2007 |
| WO | WO-2007038658 A2 | 4/2007 |
| WO | WO-2007051081 A1 | 5/2007 |
| WO | WO-2007059404 A2 | 5/2007 |
| WO | WO-2007075598 A2 | 7/2007 |

(56) References Cited

FOREIGN PATENT DOCUMENTS

| | | |
|---|---|---|
| WO | WO-2008036642 A2 | 3/2008 |
| WO | WO-2008036653 A2 | 3/2008 |
| WO | WO-2008083312 A2 | 7/2008 |
| WO | WO-2008103693 A2 | 8/2008 |
| WO | WO-2008132601 A1 | 11/2008 |
| WO | WO-2009014708 A2 | 1/2009 |
| WO | WO-2009015777 A1 | 2/2009 |
| WO | WO-2009044273 A2 | 4/2009 |
| WO | WO-2009059278 A1 | 5/2009 |
| WO | WO-2009073620 A2 | 6/2009 |
| WO | WO-2009114335 A2 | 9/2009 |
| WO | WO-2009115652 A2 | 9/2009 |
| WO | WO-2010019570 A2 | 2/2010 |
| WO | WO-2011028683 A1 | 3/2011 |
| WO | WO-2011056652 A1 | 5/2011 |
| WO | WO-2011066389 A1 | 6/2011 |
| WO | WO-2011070024 A1 | 6/2011 |
| WO | WO-2011072204 A1 | 6/2011 |
| WO | WO-2011097603 A1 | 8/2011 |
| WO | WO-2011107553 A1 | 9/2011 |
| WO | WO-2011109400 A2 | 9/2011 |
| WO | WO-2011131407 A1 | 10/2011 |
| WO | WO-2011140249 A2 | 11/2011 |
| WO | WO-2011155607 A1 | 12/2011 |
| WO | WO-2011161699 A2 | 12/2011 |
| WO | WO-2011163311 A1 | 12/2011 |
| WO | WO-2011163314 A1 | 12/2011 |
| WO | WO-2012032433 A1 | 3/2012 |
| WO | WO-2012142237 A1 | 10/2012 |
| WO | WO-2012145493 A1 | 10/2012 |
| WO | WO-2012148873 A2 | 11/2012 |
| WO | WO-2013006490 A2 | 1/2013 |
| WO | WO-2013079174 A1 | 6/2013 |
| WO | WO-2013087699 A1 | 6/2013 |
| WO | WO-2013119716 A1 | 8/2013 |
| WO | WO-2013132044 A1 | 9/2013 |
| WO | WO-2013169264 A1 | 11/2013 |
| WO | WO-2013173223 A1 | 11/2013 |
| WO | WO-2014008218 A1 | 1/2014 |
| WO | WO-2014036357 A1 | 3/2014 |
| WO | WO-2015018735 A2 | 2/2015 |
| WO | WO-2015031667 A2 | 3/2015 |
| WO | WO-2015117002 A1 | 8/2015 |
| WO | WO-2015184099 A1 | 12/2015 |
| WO | WO-2015187835 A2 | 12/2015 |
| WO | WO-2016054638 A2 | 4/2016 |
| WO | WO-2016057705 A1 | 4/2016 |
| WO | WO-2016057841 A1 | 4/2016 |
| WO | WO-2016057846 A1 | 4/2016 |
| WO | WO-2016068802 A1 | 5/2016 |
| WO | WO-2016068803 A1 | 5/2016 |
| WO | WO-2016070051 A2 | 5/2016 |
| WO | WO-2016071448 A1 | 5/2016 |
| WO | WO-2016081746 A2 | 5/2016 |
| WO | WO-2017055404 A1 | 4/2017 |
| WO | WO-2017079115 A1 | 5/2017 |
| WO | WO-2017178493 A1 | 10/2017 |
| WO | WO-2017205721 A1 | 11/2017 |
| WO | WO-2018013781 A1 | 1/2018 |
| WO | WO-2018106588 A1 | 6/2018 |
| WO | WO-2018185232 A1 | 10/2018 |
| WO | WO-2018191074 A1 | 10/2018 |
| WO | WO-2019099838 A1 | 5/2019 |

OTHER PUBLICATIONS

Dubel (Handbook of Therapeutic Antibodies, 2007, p. 100-101) (Year: 2007).*
Johnson and Wu (Methods in Molecular Biology, Antibody Engineering: Methods and Protocols, vol. 248, p. 11-25, 2004) (Year: 2004).*
Harris (Biotechnology, vol. 11, p. 1293-1297, 1993) (Year: 1993).*
Paul (Fundamental Immunology, 3rd Edition, 1993, pp. 292-295) (Year: 1993).*
Bendig M. M. (Methods: A Companion to Methods in Enzymology, 1995; 8:83-93) (Year: 1995).*
Portolano (The Journal of Immunology, vol. 150, No. 3, p. 880-887, 1993) (Year: 1993).*
Beiboer (J. Mol. Biol. (2000) 296:833-849) (Year: 2000).*
Alexander, A.J., et al., "Monitoring of IgG antibody thermal stability by micellar electrokinetic capillary chromatography and matrix-assisted laser desorption/ionization mass spectrometry," Anal. Chem. 67:3626-3632, American Chemical Society, United States (1995).
Altschul, S.F., et al., "Basic local alignment search tool," J. Mol. Biol. 215:403-410, Elsevier, Netherlands (1990).
Altschul, S.F., et al., "Gapped BLAST and PSI-BLAST: a new generation of protein database search programs," Nucleic Acids Res. 25(17):3389-3402, Oxford Academic Press, United Kingdom (1997).
Anderson, A.C., "Tim-3: an emerging target in the cancer immunotherapy landscape," Cancer Immunol. Res. 2:393-398, American Association for Cancer Research, United States (2014).
Bordusa, F., et al., "Protease-catalyzed Formation of C—N Bonds," in *Highlights in Bioorganic Chemistry*, pp. 389-403, Schmuck, C., et al., eds., Wiley-VCH Verlag GmbH & Co., Germany (2004).
Berge, S.M., et al., "Pharmaceutical salts," J. Pharm. Sci. 66:1-19, Elsevier, Netherlands (1977).
Bird, R.E., et al., "Single-chain antigen-binding proteins," Science 242:423-426, American Association for the Advancement of Science, United States (1988).
Bloeman, P.G., et al., "Adhesion molecules: a new target for immunoliposome-mediated drug delivery," FEBS Lett. 357:140-144, Wiley, United States (1995).
Boss, M.A., et al., "Genetically engineered antibodies," Immunology Today 6:12-13, Elsevier, Netherlands (1985).
Brennan, M., et al., "Preparation of bispecific antibodies by chemical recombination of monoclonal immunoglobulin G1 fragments," Science 229:81-83, American Association for the Advancement of Science, United States (1985).
He, Y., et al., "TIM-3, a promising target for cancer immunotherapy," Oncotargets and Therapy 11:7005-7009, Dove Medical Press Ltd., United Kingdom (Oct. 2018).
Bricogne, G., et al., "[23] Bayesian statistical viewpoint on structure determination: Basic concepts and examples," Meth. Enzymol. 276(A):361-423, Elsevier, Netherlands (1997).
International Search Report and Written Opinion for International Application No. PCT/US2019/013246, mailed May 17, 2019, European Patent Office, Netherlands, 14 pages.
Brummell, D.A., et al., "Probing the combining site of an anti-carbohydrate antibody by saturation-mutagenesis: role of the heavy-chain CDR3 residues," Biochem. 32:1180-1187, American Chemical Society, United States (1993).
Burks, E.A., et al., "In vitro scanning saturation mutagenesis of an antibody binding pocket," Proc. Natl. Acad. Sci. USA 94:412-417, National Academy of Sciences, United States (1997).
Zinn-Justin, S., et al., "Mapping of two "neutralizing" epitopes of a snake curaremimetic toxin by proton nuclear magnetic resonance spectroscopy," Biochemistry 32:6884-6891, American Chemical Society, United States (1993).
Chayen, N.E., "The role of oil in macromolecular crystallization," Structure 5:1269-1274, Cell Press, United States (1997).
Chen, B., et al., "Influence of histidine on the stability and physical properties of a fully human antibody in aqueous and solid forms," Pharm. Res. 20:1952-1960, Springer Science+Business Media, Germany (2003).
Zinn-Justin, S., et al., "Three-dimensional solution structure of a curaremimetic toxin from Naja nigricollis venom: a proton NMR and molecular modeling study," Biochemistry 31:11335-11347, American Chemical Society, United States (1992).
Chen, J., et al., "B cell development in mice that lack one or both immunoglobulin kappa light chain genes," EMBO J. 12:821-830, EMBO, Germany (1993).
Cheung, R.C., et al., "Epitope-specific antibody response to the surface antigen of duck hepatitis B virus in infected ducks," Virology 176:546-552, Elsevier, Netherlands (1990).

(56) References Cited

OTHER PUBLICATIONS

Choi, T.K., et al., "Transgenic mice containing a human heavy chain immunoglobulin gene fragment cloned in a yeast artificial chromosome," Nat. Genetics 4:117-123, Nature Publishing Group, United Kingdom (1993).

Cox, J.P.L., et al., "A directory of human germ-line $V_\kappa$ segments reveals a strong bias in their usage," Eur. J. Immunol. 24:827-836, Wiley-VCH, Germany (1994).

Cunningham, B.C., et al., "High-resolution epitope mapping of hGH-receptor interactions by alanine-scanning mutagenesis," Science 244:1081-1085, American Association for the Advancement of Sciences, United States (1989).

Dall Acqua, W.F., et al., "Increasing the affinity of a human IgG1 for the neonatal Fc receptor: biological consequences," J. Immunol. 169:5171-5180, American Society of Immunologists, United States (2002).

Dall Acqua, W.F., et al., "Properties of human IgG1s engineered for enhanced binding to the neonatal Fc receptor (FcRn)," J. Biol. Chem. 281:23514-23524, Elsevier, Netherlands (2006).

De Graaf, A.J., et al., "Nonnatural amino acids for site-specific protein conjugation," Bioconjug. Chem. 20:1281-1295, American Chemical Society, United States (2009).

Dranoff, G., et al., "Vaccination with irradiated tumor cells engineered to secrete murine granulocyte-macrophage colony-stimulating factor stimulates potent, specific, and long-lasting antitumor immunity," Proc. Natl. Acad. Sci. USA 90:3539-3543, National Academy of Sciences, United States (1993).

Yeung, Y.A., et al., "Engineering human IgG1 affinity to human neonatal Fc receptor: impact of affinity improvement on pharmacokinetics in primates," J. Immunol. 182:7663-7671, American Society of Immunologists, United States (2010).

Fishwild, D., et al., "High-avidity human IgG kappa monoclonal antibodies from a novel strain of minilocus transgenic mice," Nat. Biotechnol. 14:845-851, Nature Publishing Group, United Kingdom (1996).

Weinberg, A.D., et al., "Engagement of the OX-40 receptor in vivo enhances antitumor immunity," J. Immunol. 164:2160-2169, American Association of Immunologists, United States (2000).

Fourcade, J., et al., "Upregulation of Tim-3 and PD-1 expression is associated with tumor antigen-specific CD8+ T cell dysfunction in melanoma patients," J. Exp. Med. 207:2175-2186, Rockefeller University Press, United States (2010).

Frese, M.A., et al., "Formylglycine aldehyde Tag—protein engineering through a novel post-translational modification," ChemBioChem. 10:425-427, Wiley, United States (2009).

Fulda, S., et al., "Smac agonists sensitize for Apo2L/TRAIL- or anticancer drug-induced apoptosis and induce regression of malignant glioma in vivo," Nat. Med. 8:808-815, Nature Publishing Group, United Kingdom (2002).

Gala, F.A., et al., "V region carbohydrate and antibody expression," J. Immunol. 172:5489-5494, American Society of Immunologists, United States (2004).

Gautier, A., et al., "An engineered protein tag for multiprotein labeling in living cells," Chem. Biol. 15:128-136, Cell Press, United States (2008).

Ghirlando, R., et al., "Glycosylation of human IgG-Fc: influences on structure revealed by differential scanning micro-calorimetry," Immunol. Lett. 68:47-52, Elsevier, Netherlands (1999).

Wei, H., et al., "Hydrogen/deuterium exchange mass spectrometry for probing higher order structure of protein therapeutics: methodology and applications," Drug Discovery Today 19:95-102, Elsevier, Netherlands (2014).

Glennie, M.J., et al., "Preparation and performance of bispecific F(ab' gamma)2 antibody containing thioether-linked Fab' gamma fragments," J. Immunol. 139:2367-2375, American Society of Immunologists, United States (1987).

Greenberg, P.D., et al., "Deficient cellular immunity—finding and fixing the defects," Science 285:546-551, American Association for the Advancement of Science, United States (1999).

Hackenberger, C.P.R., et al., "Chemoselective ligation and modification strategies for peptides and proteins," Chem. Int. Ed. Engl. 47:10030-10074, Wiley, United States (2008).

Hahne, M., et al., "Melanoma Cell Expression of Fas(Apo-1/CD95) Ligand: Implications for Tumor Immune Escape," Science 274:1363-1365, American Association for the Advancement of Science, United States (1996).

Hambley, D.M., et al., "Laser flash photolysis of hydrogen peroxide to oxidize protein solvent-accessible residues on the microsecond timescale," J. Am. Soc. Mass Spec. 16:2057-2063, Elsevier, Netherlands (2005).

Han, G., et al., "Tim-3: an activation marker and activation limiter of innate immune cells," Front. Immunol. 4:449, Frontiers Media S.A., Switzerland (2013).

Harding, F.A., et al., "Class switching in human immunoglobulin transgenic mice," Ann. NY Acad. Sci. 764:536-546, Wiley, United States (1995).

Ward, E.S., et al., "Binding activities of a repertoire of single immunoglobulin variable domains secreted from *Escherichia coli*," Nature 341:544-546, Nature Publishing Group, United Kingdom (1989).

He, Y., et al., "Blocking programmed death-1 ligand-PD-1 interactions by local gene therapy results in enhancement of antitumor effect of secondary lymphoid tissue chemokine," J. Immunol. 173:4919-4928, American Society of Immunologists, United States (2004).

Hinton, P.R., et al., "Engineered human IgG antibodies with longer serum half-lives in primates," J. Biol. Chem. 279(8):6213-6216, Elsevier, Netherlands (2004).

Hinton, P.R., et al., "An engineered human IgG1 antibody with longer serum half-life," J. Immunol. 176:346-356, American Association of Immunologists, United States (2006).

Holliger, P., et al., "'Diabodies': small bivalent and bispecific antibody fragments," Proc. Natl. Acad. Sci. USA 90:64444-6448, National Academy of Sciences, United States (1993).

Howard, M., et al., "Biological properties of interleukin 10," Immunology Today 13:198-200, Elsevier, Netherlands (1992).

Hutloff, A., et al., "ICOS is an inducible T-cell co-stimulator structurally and functionally related to CD28," Nature 397:262-266, Nature Publishing Group, United Kingdom (1999).

Hurwitz, A.A., et al., "CTLA-4 blockade synergizes with tumor-derived granulocyte-macrophage colony-stimulating factor for treatment of an experimental mammary carcinoma," Proc. Natl. Acad. Sci. USA 95(17):10067-10071, National Academy of Sciences, United States (1998).

Huston, J.S., et al., "Protein engineering of antibody binding sites: recovery of specific activity in an anti-digoxin single-chain Fv analogue produced in *Escherichia coli*," Proc. Natl. Acad. Sci. USA 85:5879-5883, National Academy of Sciences, United States (1988).

Hyer, M., et al., "Synthetic triterpenoids cooperate with tumor necrosis factor-related apoptosis-inducing ligand to induce apoptosis of breast cancer cells," Cancer Research 65:4799-4808, American Association for Cancer Research, United States (2005).

Jefferis, R., et al., "Human immunoglobulin allotypes: possible implications for immunogenicity," MAbs 1:1, Oxford Academic Press, United Kingdom (2009).

Jespers, L.S., et al., "Guiding the selection of human antibodies from phage display repertoires to a single epitope of an antigen," Biotechnology 12:899-903, Nature Publishing Group, United Kingdom (1994).

Jones, P., et al., "Replacing the complementarity-determining regions in a human antibody with those from a mouse," Nature 321:522-525, Nature Publishing Group, United Kingdom (1986).

Kabat, E.A., et al., "Sequences of Proteins of Immunological Interest," 5th Edition, U.S. Department of Health and Human Services, United States (1991).

Karpovsky, B., et al., "Production of target-specific effector cells using hetero-cross-linked aggregates containing anti-target cell and anti-Fc gamma receptor antibodies," J. Exp. Med. 160:1686-1701, Rockefeller University Press, United States (1984).

(56) References Cited

OTHER PUBLICATIONS

Kaufman, R.J., et al., "Amplification and expression of sequences cotransfected with a modular dihydrofolate reductase complementary dna gene," Mol. Biol. 759:601-621, Elsevier, Netherlands (1982).
Kherl, J.H., et al., "Production of transforming growth factor beta by human T lymphocytes and its potential role in the regulation of T cell growth," J. Exp. Med. 163:1037-1050, Rockefeller University Press, United States (1986).
Kim, N.W., et al., "Specific Association of Human Telomerase Activity with Immortal Cells and Cancer," Science 266:2011-2013, American Association for the Advancement of Science, United States (1994).
Kirkland, T.N., et al., "Analysis of the fine specificity and cross-reactivity of monoclonal anti-lipid A antibodies," J. Immunol. 137:3614-3619, American Association of Immunologists, United States (1986).
Kobayashi, H., et al., "Tryptophan H33 plays an important role in pyrimidine (6-4) pyrimidone photoproduct binding by a high-affinity antibody," Protein Eng. 12(10):879-884 (1999).
Kostelny, S.A., et al., "Formation of a bispecific antibody by the use of leucine zippers," J. Immunol. 148:1547-1553, American Association of Immunologists, United States (1992).
Keinanen, K., et al., "Biosynthetic lipid-tagging of antibodies," FEBS Lett. 346:123-126, Wiley, United States (1994).
Wallick, S.C., et al., "Glycosylation of a VH residue of a monoclonal antibody against alpha (1-6) dextran increases its affinity for antigen," J. Exp. Med. 168:1099-1109, Rockefeller University Press, United States (1988).
Killion, J.J., et al., "Systemic targeting of liposome-encapsulated immunomodulators to macrophages for treatment of cancer metastasis," Immunomethods 4:273-279, Elsevier, Netherlands (1994).
Kohler, G., "Continuous cultures of fused cells secreting antibody of predefined specificity," Nature 256:495-497, Nature Publishing Group, United Kingdom (1975).
Krishnamurthy, R., et al., "The stability factor: importance in formulation development," Curr. Pharm. Biotechnol. 3:361-371, Bentham Science, United Arab Emirates (2002).
Kugler, A., et al., "Regression of human metastatic renal cell carcinoma after vaccination with tumor cell-dendritic cell hybrids," Nat. Med. 6:332-336, Nature Publishing Group, United Kingdom (2000).
Kuroiwa, Y., et al., "Cloned transchromosomic calves producing human immunoglobulin," Nature Biotechnology 20:889-894, Nature Publishing Group, United Kingdom (2002).
Liu, M.A., et al., "Heteroantibody duplexes target cells for lysis by cytotoxic T lymphocytes," Heteroantibody duplexes target cells for lysis by cytotoxic T lymphocytesProc. Natl. Acad. Sci. USA 82:8648, National Academy of Sciences, United States (1985).
Van Elsas, A., et al., "Elucidating the autoimmune and antitumor effector mechanisms of a treatment based on cytotoxic T lymphocyte antigen-4 blockade in combination with a B16 melanoma vaccine: comparison of prophylaxis and therapy," J. Exp. Med. 194:481-489, Rockefeller University Press, United States (2001).
Lonberg, N., "Human antibodies from transgenic animals," Nature Biotech. 23(9):1117-1125, Nature Publishing Group, United Kingdom (2005).
Lonberg, N., et al., "Antigen-specific human antibodies from mice comprising four distinct genetic modifications," Nature 368(6474):856-859, Nature Publishing Group, United Kingdom (1994).
Lonberg, N., "Transgenic Approaches to Human Monoclonal Antibodies" in *The Pharmacology of Monoclonal Antibodies*, vol. 113, pp. 49-101, Rosenberg, M., et al., eds., Springer-Verlag, Berlin, Germany (1994).
Lonberg, N., et al., "Human antibodies from transgenic mice," Intern. Rev. Immunol. 13:65-93, Taylor & Francis, United Kingdom (1995).

Urlaub, G., et al., "Isolation of Chinese hamster cell mutants deficient in dihydrofolate reductase activity," Proc. Natl. Acad. Sci. USA 77:4216-4220, National Academy of Sciences, United States (1980).
McCafferty, J., et al., "Phage antibodies: filamentous phage displaying antibody variable domains," Nature 348:552-554, Nature Publishing Group, United Kingdom (1990).
McPherson, A., et al., "Current approaches to macromolecular crystallization," Eur. J. Biochem. 189:1-23, Wiley, United States (1990).
McPherson, A., et al., "Crystallization of proteins from polyethylene glycol," J. Biol. Chem. 251:6300-6303, Elsevier, Netherlands (1976).
Melero, I., et al., "Monoclonal antibodies against the 4-1BB T-cell activation molecule eradicate established tumors," Nat. Med. 3:682-685, Nature Publishing Group, United Kingdom (1997).
Myers, E., et al., "Optimal alignments in linear space," Comput. Appl. Biosci. 4:11-17, Elewa Biosciences Journals, Kenya (1989).
Mimura, Y., et al., "The influence of glycosylation on the thermal stability and effector function expression of human IgG1-Fc: properties of a series of truncated glycoforms," Mol. Immunol. 37:697-706, Elsevier, Netherlands (2000).
Mokyr, M.B., et al., "Realization of the therapeutic potential of CTLA-4 blockade in low-dose chemotherapy-treated tumor-bearing mice," Cancer Research 58:5301-5304, American Association for Cancer Research, United States (1998).
Moldenhauer, G., et al., "Identity of HML-1 antigen on intestinal intraepithelial T cells and of B-ly7 antigen on hairy cell leukaemia," Scand. J. Immunol. 32:77-82, Wiley, United States (1990).
Morel, G.A., et al., "Monoclonal antibodies to bovine serum albumin: affinity and specificity determinations," Mol. Immunol. 25(1):7-15, Pergamon Press, United Kingdom (1988).
Morrison, S., "Transfectomas provide novel chimeric antibodies," Science 229:1202-1207, American Association for the Advancement of Science, United States (1985).
Murray, A., et al., "Epitope affinity chromatography and biophysical studies of monoclonal antibodies and recombinant antibody fragments," J. Chromatogr. Sci. 40:343-349, Oxford Academic Press, United Kingdom (2002).
Nakayama, M., et al., "Tim-3 mediates phagocytosis of apoptotic cells and cross-presentation," Blood 113:3821-3830, American Society for Hematology, United States (2009).
Needleman, S.B., et al., "A general method applicable to the search for similarities in the amino acid sequence of two proteins," J. Mol. Biol. (48):444-453, Elsevier, Netherlands (1970).
Nestle, F.O., et al., "Vaccination of melanoma patients with peptide- or tumor lysate-pulsed dendritic cells," Nat. Med. 4:328-332, Nature Publishing Group, United Kingdom (1998).
Overwijk, W.W., et al., "Vaccination with a recombinant vaccinia virus encoding a "self" antigen induces autoimmune vitiligo and tumor cell destruction in mice: requirement for CD4(+) T lymphocytes," Proc. Natl. Acad. Sci. USA 96:2982-2987, National Academy of Sciences, United States (1999).
Owais, M., et al., "Chloroquine encapsulated in malaria-infected erythrocyte-specific antibody-bearing liposomes effectively controls chloroquine-resistant Plasmodium berghei infections in mice," Antimicrob. Agents Chemother. 39:180-184, American Society for Microbiology, United States (1995).
Parekh, R.B., et al., "Association of rheumatoid arthritis and primary osteoarthritis with changes in the glycosylation pattern of total serum IgG," Nature 316:452-457, Nature Publishing Group, United States (1985).
Umezawa, F., et al., "Liposome targeting to mouse brain: mannose as a recognition marker," Biochem. Biophys. Res. Commun. 153:1038-1044, Elsevier, Netherlands (1988).
Poljak, R.L., "Production and structure of diabodies," Structure 2:1121-1123, Cell Press, United States (1994).
Queen, C., et al., "A humanized antibody that binds to the interleukin 2 receptor," Proc. Natl. Acad. Sci. USA 86:10029-10033, National Academy of Sciences, United States (1989).
Ranade, V.V., "Drug Delivery Systems. 1. Site-Specific Drug Delivery Using Liposomes as Carriers," J. Clin. Pharmacol. 29:685-694, Wiley, United States (1989).

(56) References Cited

OTHER PUBLICATIONS

Ren, H., et al., "A biocompatible condensation reaction for the labeling of terminal cysteine residues on proteins," Angew. Chem. Int. Ed. Engl. 48:9658-9662, Wiley, United States (2009).
Umana, P., et al., "Engineered glycoforms of an antineuroblastoma IgG1 with optimized antibody-dependent cellular cytotoxic activity," Nat. Biotech. 17:176-180, Nature Publishing Group, United Kingdom (1999).
Ridge, J.P., et al., "A conditioned dendritic cell can be a temporal bridge between a CD4+ T-helper and a T-killer cell," Nature 393:474-478, Nature Publishing Group, United Kingdom (1998).
Riechmann, L., et al., "Reshaping human antibodies for therapy," Nature 332:323-327, Nature Publishing Group, United Kingdom (1998).
Riedl, S., et al., "In search of a novel target—phosphatidylserine exposed by non-apoptotic tumor cells and metastases of malignancies with poor treatment efficacy," Biochim. Biophys. Acta. 1808:2638-2645, Elsevier, Netherlands (2011).
Rosenberg, S.A., "A new era for cancer immunotherapy based on the genes that encode cancer antigens," Immunity 10:281-287, Cell Press, United States (1999).
Tuaillon, N., et al., "Human immunoglobulin heavy-chain minilocus recombination in transgenic mice: gene-segment use in mu and gamma transcripts," Proc. Natl. Acad. Sci. USA 90:3720-3724, National Academy of Sciences, United States (1993).
Rosenberg, S.A., et al., "Vitiligo in patients with melanoma: normal tissue antigens can be targets for cancer immunotherapy," J. Immunother. Emphasis Tumor Immunol. 19:81-84, Elsevier, Netherlands (1996).
Roversi, P., et al., "Modelling prior distributions of atoms for macromolecular refinement and completion," Acta Cryst. Section D 56:1313-1323, Elsevier, Netherlands (2000).
Sarmay, G., et al., "Mapping and comparison of the interaction sites on the Fc region of IgG responsible for triggering antibody dependent cellular cytotoxicity (ADCC) through different types of human Fc gamma receptor," Mol. Immunol. 29(5):633-639, Pergamon Press, United Kingdom (1992).
Schenk, D., et al., "Immunization with amyloid-β attenuates Alzheimer-disease-like pathology in the PDAPP mouse," Nature 400:173-177, Nature Publishing Group, United Kingdom (1999).
Schreier, H., et al., "Targeting of liposomes to cells expressing CD4 using glycosylphosphatidylinositol-anchored gp120. Influence of liposome composition on intracellular trafficking," J. Biol. Chem. 269:9090-9098, Elsevier, Netherlands (1994).
Senter, P.D., "Potent antibody drug conjugates for cancer therapy," Curr. Opin. Chem. Biol. 13:235-244, Elsevier, Netherlands (2009).
Shields, R.L., et al., "High resolution mapping of the binding site on human IgG1 for Fc gamma RI, Fc gamma RII, Fc gamma RIII, and FcRn and design of IgG1 variants with improved binding to the Fc gamma R," J. Biol. Chem. 276(9):6591-6604, Elsevier, Netherlands (2001).
Shields, R.L., et al., "Lack of fucose on human IgG1 N-linked oligosaccharide improves binding to human Fcgamma RIII and antibody-dependent cellular toxicity," J. Biol. Chem. 277:26733-26740, Elsevier, Netherlands (2002).
Songsivilai, S., et al., "Bispecific antibody: a tool for diagnosis and treatment of disease," Clin. Exp. Immunol. 79:315-321, Oxford Academic Press, United Kingdom (1990).
Spiro, R.G., "Protein glycosylation: nature, distribution, enzymatic formation, and disease implications of glycopeptide bonds," Glycobiology 12(4):43R-56R, Oxford Academic Press, United Kingdom (2002).
Stahli, C., et al., "Distinction of epitopes by monoclonal antibodies," Methods in Enzymology 9:242-253, Elsevier, Netherlands (1983).
Strohl, W.R., "Optimization of Fc-mediated effector functions of monoclonal antibodies," Curr. Opin. Biotechnol. 20:685-691, Elsevier, Netherlands (2009).
Sunbul, M., et al., "Site specific protein labeling by enzymatic posttranslational modification," Org. Biomol. Chem. 7:3361-3371, Royal Society of Chemistry, United Kingdom (2009).
Suto, R., et al., "A mechanism for the specific immunogenicity of heat shock protein- chaperoned peptides," Science 269:1585-1588, American Association for the Advancement of Science, United States (1995).
Takebe, Y., et al., "SR alpha promoter: an efficient and versatile mammalian cDNA expression system composed of the simian virus 40 early promoter and the R-U5 segment of human T-cell leukemia virus type 1 long terminal repeat," Mol. Cell. Biol. 8:466-472, American Society for Microbiology, United States (1988).
Taki, M., et al., "Transglutaminase-mediated N- and C-terminal fluorescein labeling of a protein can support the native activity of the modified protein," Prot. Eng. Des. Sel. 17:119-126, Oxford Academic Press, United Kingdom (2004).
Tamura, Y., et al., "Immunotherapy of tumors with autologous tumor-derived heat shock protein preparations," Science 278:117-120, American Association for the Advancement of Science, United States (1997).
Taylor, L., et al., "A transgenic mouse that expresses a diversity of human sequence heavy and light chain immunoglobulins," Nucleic Acids Res. 20:6287-6295, Oxford Academic Press, United Kingdom (1992).
Taylor, L., et al., "Human immunoglobulin transgenes undergo rearrangement, somatic mutation and class switching in mice that lack endogenous IgM," Int. Immunol. 6:579-591, Oxford Academic Press, United Kingdom (1994).
Taylor, E., et al., "Native Chemical Ligation: Semi Synthesis of Post-translationally Modified Proteins and Biological Probes," in *Protein Engineering*, pp. 65-96, Kohrer, C., et al., eds., Springer-Verlag Berlin Heidelberg, Germany (2009).
Tomlinson, I.M., et al., "The repertoire of human germline VH sequences reveals about fifty groups of VH segments with different hypervariable loops," J. Mol. Biol. 227:776-798, Elsevier, Netherlands (1992).
Tomizuka, K., et al., "Double trans-chromosomic mice: maintenance of two individual human chromosome fragments containing Ig heavy and kappa loci and expression of fully human antibodies," Proc. Natl. Acad. Sci. USA 97:722-727, National Academy of Sciences, United States (2000).
Tuaillon, N., et al., "Biased utilization of DHQ52 and JH4 gene segments in a human Ig transgenic minilocus is independent of antigenic selection," Immunol. 152:2912-2920, American Association of Immunologists, United States (1994).
Baitsch, L., et al., "Exhaustion of tumor-specific CD8+ T cells in metastases from melanoma patients," *The Journal of Clinical Investigation* 121(6):2350-2360, the American Society for Clinical Investigation, United States (Jun. 2011).
Das, M., et al., "Tim-3 and its role in regulating anti-tumor immunity," *Immunological Reviews* 276(1):97-111, Wiley-Blackwell Publishing Ltd., United Kingdom (Mar. 2017).
Du, W., et al., "TIM-3 as a Target for Cancer Immunotherapy and Mechanisms of Action," *International Journal of Molecular Sciences* 18(3):645, MDPI Multidisciplinary Digital Publishing Institute, Switzerland (Mar. 2017).
Ge, W., et al., "Tim-3 as a diagnostic and prognostic biomarker of osteosarcoma," *Tumor Biology* 39(7):1010428317715643, 8 pages, SAGE Publications Inc., United States (Jul. 2017).
Gros, A., et al., "PD-1 identifies the patient-specific CD8+ tumor-reactive repertoire infiltrating human tumors," *The Journal of Clinical Investigation* 124(5):2246-2259, the American Society for Clinical Investigation, United States (May 2014).
Ngiow, S.F., et al., "Anti-TIM3 Antibody Promotes T Cell IFN-g-Mediated Antitumor Immunity and Suppresses Established Tumors," *Cancer Res.* 71(10):3540-3551, American Association for Cancer Research, United States (May 2011).
Silva, I. G., et al., "The Tim-3-galectin-9 Secretory Pathway is Involved in the Immune Escape of Human Acute Myeloid Leukemia Cells," *EBioMedicine* 22:44-57, Elsevier BV, Netherlands (Aug. 2017).
Weiss, G.J., et al., "A phase 1 study of TSR-022, an anti-TIM-3 monoclonal antibody, in patients (pts) with advanced solid tumors," *Journal for ImmunoTherapy of Cancer* (Suppl 2):86 (Abstract O13), Society for Immunotherapy of Cancer (SITC), United States (Nov. 2017).

(56) References Cited

OTHER PUBLICATIONS

Bose, B., and Sinha, S., "Problems in using statistical analysis of replacement and silent mutations in antibody genes for determining antigen-driven affinity selection," Immunology 116(2):172-183, Wiley-Blackwell Publishing Ltd., United Kingdom (Oct. 2005).

De Pascalis, R., et al., "Grafting of 'abbreviated' complementarity-determining regions containing specificity-determining residues essential for ligand contact to engineer a less immunogenic humanized monoclonal antibody," J Immunol 169(6):3076-3084, Nature Publishing Group, United Kingdom (Sep. 2002).

Fenton, A., et al., "Rheostat positions: A new classification of protein positions relevant to pharmacogenomics," Medicinal Chemistry Research 29(7):1133-1146, Birkhauser Boston, United States (Jun. 2020).

Ferris, R., et al., "Too Much of a Good Thing? Tim-3 and TCR Signaling in T Cell Exhaustion," J Immunol 193(4):1525-1530, Nature Publishing Group, United Kingdom (Aug. 2014).

Guo, H., et al., "Protein tolerance to random amino acid change," PNAS USA 101(25):9205-9210, National Academy of Sciences, United States (Jun. 2004).

Ha, L., et al., "Animal models of melanoma," J Investig Dermatol Symposium Proceedings 10(2):86-89, Nature Publishing Group, United Kingdom (Nov. 2005).

Justice, M., and Dhillon, P., "Using the mouse to model human disease: increasing validity and reproducibility," Disease, Models & Mechanisms 9(2):101-103, Company of Biologists Ltd., United Kingdom (Feb. 2016).

Kikushige, Y., and Miyamoto, T., "TIM-3 as a novel therapeutic target for eradicating acute myelogenous leukemia stem cells," International Journal of Hematology 98(6):627-633, Springer Japan, Japan (Sep. 2013).

Kreig, C., et al., "Functional analysis of B and T lymphocyte attenuator engagement on CD4+ and CD8+ T cells," J. Immunol 175(10):6420-6427, Nature Publishing Group, United Kingdom (Nov. 2005).

McKinney, A., and Holmen, S., "Animal models of melanoma: a somatic cell gene delivery mouse model allows rapid evaluation of genes implicated in human melanoma," Chinese J Cancer 30(3):153-162, Biomed Central Ltd., United Kingdom (Mar. 2011).

Morris, G.E., "Epitope Mapping of Protein Antigens by Competition ELISA," The Protein Protocols Handbook, pp. 595-600, Humana Press, United States (1996).

Tokuriki, N., and Tawfik, D., "Stability effects of mutations and protein evolvability," Curr. Opin. Struc. Biol 19(5):596-604, John Wiley & Sons Inc., United States (Sep. 2009).

Vajdos, F., et al., "Comprehensive functional maps of the antigen-binding site of an anti-ErobB2 antibody obtained with shotgun scanning mutagenesis," J Mol Biol 320(2):415-428, Academic Press Inc., United States (Jul. 2002).

* cited by examiner

FIG. 1A

Anti-TIM-3 13A3 VH1

V segment: 4-39

D segment: 4-17

J segment: JH5b

```
        Q   L   Q   L   Q   E   S   G   P   G   L   V   K   P   S   E   T
1       CAG CTG CAG CTG CAG GAG TCG GGC CCA GGA CTG GTG AAG CCT TCG GAG ACC

_CDR1_____
        L   S   L   T   C   T   V   S   G   G   S   I   S   S   R   S   Y
52      CTG TCC CTC ACC TGC ACT GTC TCT GGT GGC TCC ATC AGC AGT AGA AGT TAC

_____
        Y   W   G   W   I   R   Q   P   P   G   K   G   L   E   W   I   G
103     TAC TGG GGC TGG ATC CGC CAG CCC CCA GGG AAG GGG CTG GAG TGG ATT GGG

_CDR2_____
        S   I   Y   Y   S   G   F   T   Y   Y   N   P   S   L   K   S   R
154     AGT ATC TAT TAT AGT GGG TTC ACC TAC TAC AAC CCG TCC CTC AAG AGT CGA

V   T   I   S   V   D   T   S   K   N   Q   F   S   L   K   L   S
205     GTC ACC ATA TCC GTT GAC ACG TCC AAG AAC CAG TTC TCC CTG AAG CTG AGC

_CDR3_____
        S   V   T   A   A   D   T   A   V   Y   Y   C   A   T   G   G   P
256     TCT GTG ACC GCC GCA GAC ACG GCT GTG TAT TAT TGT GCG ACA GGG GGG CCC

_____
        Y   G   D   Y   A   H   W   F   D   P   W   G   Q   G   T   L   V
307     TAC GGT GAC TAC GCC CAC TGG TTC GAC CCC TGG GGC CAG GGA ACC CTG GTC

T   V   S   S
358     ACC GTC TCC TCA
```

FIG. 1B

Anti-TIM-3 13A3 VK1

V segment: A27

J segment: JK5

```
         E    I    V    L    T    Q    S    P    G    T    L    S    L    S    P    G    E
1       GAA  ATT  GTG  TTG  ACG  CAG  TCT  CCA  GGC  ACC  CTG  TCT  TTG  TCT  CCA  GGG  GAA

_CDR1_____
         R    A    T    L    S    C    R    A    S    Q    S    V    S    S    S    Y    L
52      AGA  GCC  ACC  CTC  TCC  TGC  AGG  GCC  AGT  CAG  AGT  GTT  AGC  AGC  AGC  TAC  TTA

___
         A    W    Y    Q    Q    K    P    G    Q    A    P    R    L    L    I    Y    G
103     GCC  TGG  TAC  CAG  CAG  AAA  CCT  GGC  CAG  GCT  CCC  AGG  CTC  CTC  ATC  TAT  GGT

__CDR2_____
         A    S    S    R    A    T    G    I    P    D    R    F    S    G    S    G    S
154     GCA  TCC  AGC  AGG  GCC  ACT  GGC  ATC  CCA  GAC  AGG  TTC  AGT  GGC  AGT  GGG  TCT

G    T    D    F    T    L    T    I    S    R    L    E    P    E    D    F    A
205     GGG  ACA  GAC  TTC  ACT  CTC  ACC  ATC  AGC  AGA  CTG  GAG  CCT  GAA  GAT  TTT  GCA

_CDR3_____
         V    Y    Y    C    Q    Q    Y    G    S    S    P    I    T    F    G    Q    G
256     GTG  TAT  TAC  TGT  CAG  CAG  TAT  GGT  AGC  TCA  CCG  ATC  ACC  TTC  GGC  CAA  GGG

T    R    L    E    I    K
307     ACA  CGA  CTG  GAG  ATT  AAA
```

FIG. 1C

13A3 _NT_VH1
ATGAAGCACCTGTGGTTCTTCCTCCTGCTGGTGGCGGCTCCCAGATGGGTCCTGTCCCAGCTGCAGCTGCAGGAG
TCGGGCCCAGGACTGGTGAAGCCTTCGGAGACCCTGTCCCTCACCTGCACTGTCTCTGGTGGCTCCATCAGCAGT
AGAAGTTACTACTGGGGCTGGATCCGCCAGCCCCCAGGGAAGGGGCTGGAGTGGATTGGGAGTATCTATTATAGT
GGGTTCACCTACTACAACCCGTCCCTCAAGAGTCGAGTCACCATATCCGTTGACACGTCCAAGAACCAGTTCTCC
CTGAAGCTGAGCTCTGTGACCGCCGCAGACACGGCTGTGTATTATTGTGCGACAGGGGGGCCCTACGGTGACTAC
GCCCACTGGTTCGACCCCTGGGGCCAGGGAACCCTGGTCACCGTCTCCTCA

13A3 _AA_VH1
MKHLWFFLLLVAAPRWVLSQLQLQESGPGLVKPSETLSLTCTVSGGSISSRSYYWGWIRQPPGKGLEWIGSIYYS
GFTYYNPSLKSRVTISVDTSKNQFSLKLSSVTAADTAVYYCATGGPYGDYAHWFDPWGQGTLVTVSS

13A3 _NT_VK1
ATGGAAACCCCAGCGCAGCTTCTCTTCCTCCTGCTACTCTGGCTCCCAGATACCACCGGAGAAATTGTGTTGACG
CAGTCTCCAGGCACCCTGTCTTTGTCTCCAGGGGAAAGAGCCACCCTCTCCTGCAGGGCCAGTCAGAGTGTTAGC
AGCAGCTACTTAGCCTGGTACCAGCAGAAACCTGGCCAGGCTCCCAGGCTCCTCATCTATGGTGCATCCAGCAGG
GCCACTGGCATCCCAGACAGGTTCAGTGGCAGTGGGTCTGGGACAGACTTCACTCTCACCATCAGCAGACTGGAG
CCTGAAGATTTTGCAGTGTATTACTGTCAGCAGTATGGTAGCTCACCGATCACCTTCGGCCAAGGGACACGACTG
GAGATTAAA

13A3_AA_VK1
METPAQLLFLLLLWLPDTTGEIVLTQSPGTLSLSPGERATLSCRASQSVSSSYLAWYQQKPGQAPRLLIYGASSR
ATGIPDRFSGSGSGTDFTLTISRLEPEDFAVYYCQQYGSSPITFGQGTRLEIK

FIG. 2A

Anti-TIM-3 8B9 VH1

V segment: 4-59

D segment: 4-17

J segment: JH6b

```
      Q   V   Q   L   Q   E   S   G   P   G   L   V   K   P   S   E   T
  1   CAG GTG CAG CTG CAG GAG TCG GGC CCA GGA CTG GTG AAG CCT TCG GAG ACC

_CDR1_____
      L   S   L   T   C   T   V   S   G   G   S   I   S   R   H   Y   W
 52   CTG TCC CTC ACC TGC ACT GTC TCT GGT GGC TCC ATC AGT CGT CAC TAC TGG

__                                                       _CDR2__
      N   W   I   R   Q   P   P   G   K   G   L   E   W   I   G   Y   I
103   AAC TGG ATC CGG CAG CCC CCA GGG AAG GGA CTG GAG TGG ATT GGG TAT ATC

_____
      H   Y   S   G   S   T   N   Y   N   S   S   L   K   S   R   V   T
154   CAT TAC AGT GGA AGC ACC AAC TAC AAT TCC TCC CTC AAG AGT CGA GTC ACC

I   S   V   D   T   S   K   N   Q   F   S   L   K   L   S   S   V
205   ATA TCA GTA GAC ACG TCC AAG AAC CAG TTC TCC CTG AAG CTG AGC TCT GTG

_CDR3_____
      T   A   A   D   T   A   V   Y   Y   C   A   R   D   T   G   Y   Y
256   ACC GCT GCG GAC ACG GCC GTG TAT TAC TGT GCG AGA GAT ACT GGG TAC TAC

_____
      G   M   D   I   W   G   Q   G   T   T   V   T   V   S   S
307   GGT ATG GAC ATC TGG GGC CAA GGG ACC ACG GTC ACC GTC TCC TCA
```

FIG. 2B

Anti-TIM-3 8B9 VK1 (hKappa)

V segment: A27

J segment: JK4

```
        E   I   V   L   T   Q   S   P   G   T   L   S   L   S   P   G   E
  1    GAA ATT GTG TTG ACG CAG TCT CCA GGC ACC CTG TCT TTG TCT CCA GGG GAA

_CDR1_____
        R   A   T   L   S   C   R   A   S   Q   S   V   S   S   S   Y   L
 52    AGA GCC ACC CTC TCC TGC AGG GCC AGT CAG AGT GTT AGC AGC AGC TAC TTA

___
        A   W   Y   Q   Q   K   P   G   Q   A   P   R   L   L   I   Y   G
103    GCC TGG TAC CAG CAG AAA CCT GGC CAG GCT CCC AGG CTC CTC ATC TAT GGT

_CDR2_____
        A   S   S   R   A   T   G   I   P   D   R   F   S   G   S   G   S
154    GCA TCC AGC AGG GCC ACT GGC ATC CCA GAC AGG TTC AGT GGC AGT GGG TCT

G   T   D   F   T   L   T   I   S   R   L   E   P   E   D   F   A
205    GGG ACA GAC TTC ACT CTC ACC ATC AGC AGA CTG GAG CCT GAA GAT TTT GCA

_CDR3_____
        V   Y   Y   C   Q   Q   Y   G   S   S   P   L   T   F   G   G   G
256    GTG TAT TAC TGT CAG CAG TAT GGT AGC TCA CCT CTC ACT TTC GGC GGA GGG

T   K   V   E   I   K
307    ACC AAG GTG GAG ATC AAA
```

FIG. 2C

8B9 NT_VH1
ATGAAACATCTGTGGTTCTTCCTTCTCCTGGTGGCAGCTCCCAGATGGGTCCTGTCCCAGGTGCAGCTGCAGGAG
TCGGGCCCAGGACTGGTGAAGCCTTCGGAGACCCTGTCCCTCACCTGCACTGTCTCTGGTGGCTCCATCAGTCGT
CACTACTGGAACTGGATCCGGCAGCCCCCAGGGAAGGGACTGGAGTGGATTGGGTATATCCATTACAGTGGAAGC
ACCAACTACAATTCCTCCCTCAAGAGTCGAGTCACCATATCAGTAGACACGTCCAAGAACCAGTTCTCCCTGAAG
CTGAGCTCTGTGACCGCTGCGGACACGGCCGTGTATTACTGTGCGAGAGATACTGGGTACTACGGTATGGACATC
TGGGGCCAAGGGACCACGGTCACCGTCTCCTCA

8B9 _AA_VH1
MKHLWFFLLLVAAPRWVLSQVQLQESGPGLVKPSETLSLTCTVSGGSISRHYWNWIRQPPGKGLEWIGYIHYSGS
TNYNSSLKSRVTISVDTSKNQFSLKLSSVTAADTAVYYCARDTGYYGMDIWGQGTTVTVSS

8B9 _NT_VK1
ATGGAAACCCCAGCGCAGCTTCTCTTCCTCCTGCTACTCTGGCTCCCAGATACCACCGGAGAAATTGTGTTGACG
CAGTCTCCAGGCACCCTGTCTTTGTCTCCAGGGGAAAGAGCCACCCTCTCCTGCAGGGCCAGTCAGAGTGTTAGC
AGCAGCTACTTAGCCTGGTACCAGCAGAAACCTGGCCAGGCTCCCAGGCTCCTCATCTATGGTGCATCCAGCAGG
GCCACTGGCATCCCAGACAGGTTCAGTGGCAGTGGGTCTGGGACAGACTTCACTCTCACCATCAGCAGACTGGAG
CCTGAAGATTTTGCAGTGTATTACTGTCAGCAGTATGGTAGCTCACCTCTCACTTTCGG
CGGAGGGACCAAGGTGGAGATCAAA

8B9 _AA_VK1
METPAQLLFLLLLWLPDTTGEIVLTQSPGTLSLSPGERATLSCRASQSVSSSYLAWYQQKPGQAPRLLIYGASSR
ATGIPDRFSGSGSGTDFTLTISRLEPEDFAVYYCQQYGSSPLTFGGGTKVEIK

FIG. 3A

Anti-TIM-3 8C4 VH1

V segment: 4-59

D segment: 4-17

J segment: JH6b

```
        Q   V   Q   L   Q   E   S   G   P   G   L   V   K   P   S   E   T
1       CAG GTG CAG CTG CAG GAG TCG GGC CCA GGA CTG GTG AAG CCT TCG GAG ACC

_CDR1_____
        L   S   L   T   C   T   V   S   G   G   S   I   S   R   Y   Y   W
52      CTG TCC CTC ACC TGC ACT GTC TCT GGT GGC TCC ATC AGT CGT TAC TAC TGG

__                                                      _CDR2___
        S   W   I   R   Q   P   P   G   K   G   L   E   W   I   G   Y   I
103     AGC TGG ATC CGG CAG CCC CCA GGG AAG GGA CTG GAG TGG ATT GGG TAT ATC

_____
        H   Y   T   G   S   T   N   Y   N   P   S   L   K   S   R   V   T
154     CAT TAC ACT GGG AGC ACC AAC TAC AAC CCC TCC CTC AAG AGT CGA GTC ACC

I   S   V   D   T   S   K   N   Q   F   S   L   K   L   S   S   V
205     ATA TCA GTA GAC ACG TCC AAG AAC CAG TTC TCC CTG AAG CTG AGC TCT GTG

_CDR3_____
        T   A   A   D   T   A   V   Y   Y   C   A   T   D   T   G   Y
256     ACC GCA GCG GAC ACG GCC GTG TAT TAC TGT GCG ACA GAT ACG GGC TAC

_____
        Y   G   M   D   V   W   G   Q   G   T   T   V   T   V   S   S
307     TAC GGT ATG GAC GTC TGG GGC CAA GGG ACC ACG GTC ACC GTC TCC TCA
```

FIG. 3B

Anti-TIM-3 8C4 VK1

V segment: A27

J segment: JK4

```
         E   I   V   L   T   Q   S   P   G   T   L   S   L   S   P   G   E
1        GAA ATT GTG TTG ACG CAG TCT CCA GGC ACC CTG TCT TTG TCT CCA GGG GAA

_CDR1_____
         R   A   T   L   S   C   R   A   S   Q   S   V   S   S   S   Y   L
52       AGA GCC ACC CTC TCC TGC AGG GCC AGT CAG AGT GTT AGC AGC AGC TAC TTA

___
         A   W   Y   Q   Q   K   P   G   Q   A   P   R   L   L   I   Y   G
103      GCC TGG TAC CAG CAG AAA CCT GGC CAG GCT CCC AGG CTC CTC ATC TAT GGT

___CDR2_____
         A   S   S   R   A   T   G   I   P   D   R   F   S   G   S   G   S
154      GCA TCC AGC AGG GCC ACT GGC ATC CCA GAC AGG TTC AGT GGC AGT GGG TCT

G   T   D   F   T   L   T   I   S   R   L   E   P   E   D   F   A
205      GGG ACA GAC TTC ACT CTC ACC ATC AGC AGA CTG GAG CCT GAA GAT TTT GCA

_CDR3_____
         V   Y   Y   C   Q   Q   Y   G   S   S   P   L   T   F   G   G   G
256      GTG TAT TAC TGT CAG CAG TAT GGT AGC TCA CCG CTC ACT TTC GGC GGA GGG

T   K   V   E   I   K
307      ACC AAG GTG GAG ATC AAA
```

ATGAAACATCTGTGGTTCTTCCTTCTCCTGGTGGCAGCTCCCAGATGGGTCCTGTCCCAGGTGCAGCTGCAGGAG
TCGGGCCCAGGACTGGTGAAGCCTTCGGAGACCCTGTCCCTCACCTGCACTGTCTCTGGTGGCTCCATCAGTCGT
TACTACTGGAGCTGGATCCGGCAGCCCCCAGGGAAGGGACTGGAGTGGATTGGGTATATCCATTACACTGGGAGC
ACCAACTACAACCCCTCCCTCAAGAGTCGAGTCACCATATCAGTAGACACGTCCAAGAACCAGTTCTCCCTGAAG
CTGAGCTCTGTGACCGCAGCGGACACGGCCGTGTATTACTGTGCGACAGATACGGGCTACTACGGTATGGACGTC
TGGGGCCAAGGGACCACGGTCACCGTCTCCTCA

8C4_AA_VH1

MKHLWFFLLLVAAPRWVLSQVQLQESGPGLVKPSETLSLTCTVSGGSISRYYWSWIRQPPGKGLEWIGYIHYTGS
TNYNPSLKSRVTISVDTSKNQFSLKLSSVTAADTAVYYCATDTGYYGMDVWGQGTTVTVSS

8C4_NT_VK1

ATGGAAACCCCAGCGCAGCTTCTCTTCCTCCTGCTACTCTGGCTCCCAGATACCACCGGAGAAATTGTGTTGACG
CAGTCTCCAGGCACCCTGTCTTTGTCTCCAGGGGAAAGAGCCACCCTCTCCTGCAGGGCCAGTCAGAGTGTTAGC
AGCAGCTACTTAGCCTGGTACCAGCAGAAACCTGGCCAGGCTCCCAGGCTCCTCATCTATGGTGCATCCAGCAGG
GCCACTGGCATCCCAGACAGGTTCAGTGGCAGTGGGTCTGGGACAGACTTCACTCTCACCATCAGCAGACTGGAG
CCTGAAGATTTTGCAGTGTATTACTGTCAGCAGTATGGTAGCTCACCGCTCACTTTCGGCGGAGGGACCAAGGTG
GAGATCAAA

8C4_AA_VK1

METPAQLLFLLLLWLPDTTGEIVLTQSPGTLSLSPGERATLSCRASQSVSSSYLAWYQQKPGQAPRLLIYGASSR
ATGIPDRFSGSGSGTDFTLTISRLEPEDFAVYYCQQYGSSPLTFGGGTKVEIK

FIG. 4A

Anti-TIM-3 17C3 VH1

V segment: 1-46

D segment: 3-10

J segment: JH6b

```
        Q   V   Q   L   V   Q   S   G   A   E   V   K   K   P   G   A   S
1       CAG GTG CAG TTG GTG CAG TCT GGG GCT GAG GTG AAG AAG CCT GGG GCC TCA

_CDR1_____
        V   K   V   S   C   K   A   S   G   Y   T   F   T   S   Y   Y   M
52      GTG AAG GTC TCC TGC AAG GCA TCT GGA TAC ACT TTC ACC AGC TAC TAT ATG

__                                                      _CDR2__
        H   W   V   R   Q   A   P   G   Q   G   L   E   W   M   G   I   I
103     CAC TGG GTG CGA CAG GCC CCT GGA CAA GGG CTT GAG TGG ATG GGA ATA ATC

N   P   R   G   D   S   I   I   Y   A   Q   K   F   Q   G   R   V
154     AAC CCT AGG GGT GAT AGC ATA ATC TAC GCA CAG AAG TTC CAG GGC AGA GTC

T   M   T   R   D   T   S   T   S   T   V   Y   M   E   L   S   S
205     ACC ATG ACC AGG GAC ACG TCC ACG AGC ACA GTC TAC ATG GAG CTG AGC AGC

_CDR3_____
        L   R   S   E   D   T   A   V   Y   Y   C   R   D   F   Y   G
256     CTG AGA TCT GAG GAC ACG GCC GTG TAT TAC TGT GCG AGA GAT TTC TAT GGT

S   G   N   Y   Y   Y   G   M   D   V   W   G   Q   G   T   T   V
307     TCG GGA AAC TAC TAC TAC GGT ATG GAC GTC TGG GGC CAA GGG ACC ACG GTC

T   V   S   S
358     ACC GTC TCC TCA
```

FIG. 4B

Anti-TIM-3 17C3 VK1

V segment: A27

J segment: JK5

```
         E   I   V   L   T   Q   S   P   G   T   L   S   L   S   P   G   E
  1      GAA ATT GTG TTG ACG CAG TCT CCA GGC ACC CTG TCT TTG TCT CCA GGG GAA

_CDR1_____
         R   A   T   L   S   C   R   A   S   Q   S   V   S   S   S   Y   L
 52      AGA GCC ACC CTC TCC TGC AGG GCC AGT CAG AGT GTT AGC AGC AGC TAC TTA

___
         A   W   Y   Q   Q   K   P   G   Q   A   P   R   L   L   I   Y   G
103      GCC TGG TAC CAG CAG AAA CCT GGC CAG GCT CCC AGG CTC CTC ATC TAT GGT

___CDR2_____
         A   S   S   R   A   T   G   I   P   D   R   F   S   G   S   G   S
154      GCA TCC AGC AGG GCC ACT GGC ATC CCA GAC AGG TTC AGT GGC AGT GGG TCT

G   T   D   F   T   L   T   I   S   R   L   E   P   E   D   F   A
205      GGG ACA GAC TTC ACT CTC ACC ATC AGC AGA CTG GAG CCT GAA GAT TTT GCA

_CDR3_____
         V   Y   Y   C   Q   Q   Y   G   S   S   P   I   T   F   G   Q   G
256      GTG TAT TAC TGT CAG CAG TAT GGT AGC TCA CCG ATC ACC TTC GGC CAA GGG

T   R   L   E   I   K
307      ACA CGA CTG GAG ATT AAA
```

ATGGACTGGACCTGGAGGGTCTTCTGCTTGCTGGCTGTAGCTCCAGGTGCTCACTCCCAGGTGCAGTTGGTGCAG
TCTGGGGCTGAGGTGAAGAAGCCTGGGGCCTCAGTGAAGGTCTCCTGCAAGGCATCTGGATACACTTTCACCAGC
TACTATATGCACTGGGTGCGACAGGCCCCTGGACAAGGGCTTGAGTGGATGGGAATAATCAACCCTAGGGGTGAT
AGCATAATCTACGCACAGAAGTTCCAGGGCAGAGTCACCATGACCAGGGACACGTCCACGAGCACAGTCTACATG
GAGCTGAGCAGCCTGAGATCTGAGGACACGGCCGTGTATTACTGTGCGAGAGATTTCTATGGTTCGGGAAACTAC
TACTACGGTATGGACGTCTGGGGCCAAGGGACCACGGTCACCGTCTCCTCA

17C3_AA_VH1

MDWTWRVFCLLAVAPGAHSQVQLVQSGAEVKKPGASVKVSCKASGYTFTSYYMHWVRQAPGQGLEWMGIINPRGD
SIIYAQKFQGRVTMTRDTSTSTVYMELSSLRSEDTAVYYCARDFYGSGNYYYGMDVWGQGTTVTVSS

17C3_NT_VK1

ATGGAAACCCCAGCGCAGCTTCTCTTCCTCCTGCTACTCTGGCTCCCAGATACCACCGGAGAAATTGTGTTGACG
CAGTCTCCAGGCACCCTGTCTTTGTCTCCAGGGGAAAGAGCCACCCTCTCCTGCAGGGCCAGTCAGAGTGTTAGC
AGCAGCTACTTAGCCTGGTACCAGCAGAAACCTGGCCAGGCTCCCAGGCTCCTCATCTATGGTGCATCCAGCAGG
GCCACTGGCATCCCAGACAGGTTCAGTGGCAGTGGGTCTGGGACAGACTTCACTCTCACCATCAGCAGACTGGAG
CCTGAAGATTTTGCAGTGTATTACTGTCAGCAGTATGGTAGCTCACCGATCACCTTCGGCCAAGGGACACGACTG
GAGATTAAA

17C3_AA_VK1

METPAQLLFLLLLWLPDTTGEIVLTQSPGTLSLSPGERATLSCRASQSVSSSYLAWYQQKPGQAPRLLIYGASSR
ATGIPDRFSGSGSGTDFTLTISRLEPEDFAVYYCQQYGSSPITFGQGTRLEIK

FIG. 5A

Anti-TIM-3 9F6 VH1

V segment: 3-11

D segment: 6-19

J segment: JH6b

```
       Q    V    Q    L    V    E    S    G    G    G    L    V    K    P    G    G    S
1      CAG  GTG  CAG  CTG  GTG  GAG  TCT  GGG  GGA  GGC  TTG  GTC  AAG  CCT  GGA  GGG  TCC

_CDR1_____
       L    R    L    S    C    A    A    S    G    F    T    F    S    D    Y    Y    M
52     CTG  AGA  CTC  TCC  TGT  GCA  GCC  TCT  GGA  TTC  ACC  TTC  AGT  GAC  TAC  TAC  ATG

_CDR2__
       S    W    I    R    Q    A    P    G    K    G    L    E    W    V    S    F    I
103    AGC  TGG  ATC  CGC  CAG  GCT  CCA  GGG  AAG  GGG  CTG  GAG  TGG  GTT  TCA  TTC  ATT

S    G    G    G    S    T    I    Y    Y    A    D    S    V    K    G    R    F
154    AGT  GGT  GGT  GGT  AGT  ACC  ATA  TAC  TAC  GCA  GAC  TCT  GTG  AAG  GGC  CGA  TTC

T    I    S    R    D    N    A    K    N    S    L    F    L    Q    M    N    S
205    ACC  ATC  TCC  AGG  GAC  AAC  GCC  AAG  AAC  TCG  CTG  TTT  CTG  CAA  ATG  AAC  AGC

_CDR3_____
       L    R    V    E    D    T    A    V    Y    Y    C    A    R    D    G    Y    S
256    CTG  AGA  GTC  GAG  GAC  ACG  GCT  GTG  TAT  TAC  TGT  GCG  AGA  GAT  GGC  TAT  AGC

S    G    W    Y    Y    Y    G    M    D    V    W    G    Q    G    T    A    V
307    AGT  GGC  TGG  TAC  TAC  TAC  GGT  ATG  GAC  GTC  TGG  GGC  CAA  GGG  ACC  GCG  GTC

T    V    S    S
358    ACC  GTC  TCC  TCA
```

FIG. 5B

Anti-TIM-3 9F6 VK1

V segment: L18

J segment: JK1

```
         A   I   Q   L   T   Q   S   P   S   S   L   S   A   S   V   G   D
  1     GCC ATC CAG TTG ACC CAG TCT CCA TCC TCC CTG TCT GCA TCT GTA GGA GAC

_CDR1_____
         R   V   T   I   T   C   R   A   S   Q   G   I   S   S   A   L   A
 52     AGA GTC ACC ATC ACT TGC CGG GCA AGT CAG GGC ATT AGC AGT GCT TTA GCC

_CDR2___
         W   Y   Q   Q   K   P   G   K   A   P   K   L   L   I   Y   D   A
103     TGG TAT CAG CAG AAA CCA GGG AAA GCT CCT AAG CTC CTG ATC TAT GAT GCC

S   S   L   E   S   G   V   P   S   R   F   S   G   S   G   S   G
154     TCC AGT TTG GAA AGT GGG GTC CCA TCA AGG TTC AGC GGC AGT GGA TCT GGG

T   D   F   T   L   T   I   S   S   L   Q   P   E   D   F   A   T
205     ACA GAT TTC ACT CTC ACC ATC AGC AGC CTG CAG CCT GAA GAT TTT GCA ACT

_CDR3_____
         Y   Y   C   Q   Q   F   N   S   Y   P   R   T   F   G   Q   G   T
256     TAT TAC TGT CAA CAG TTT AAT AGT TAC CCT CGG ACG TTC GGC CAA GGG ACC

K   V   E   I   K
307     AAG GTG GAA ATC AAA
```

FIG. 5C

Anti-TIM-3 9F6 VK2

V segment: A27

J segment: JK4

```
        E   I   V   L   T   Q   S   P   G   T   L   S   L   S   P   G   E
1       GAA ATT GTG TTG ACG CAG TCT CCA GGC ACC CTG TCT TTG TCT CCA GGG GAA

_CDR1_____
        R   A   T   L   S   C   R   A   S   Q   S   V   S   S   S   Y   L
52      AGA GCC ACC CTC TCC TGC AGG GCC AGT CAG AGT GTT AGC AGC AGC TAC TTA

_____
        A   W   Y   Q   Q   K   P   G   Q   A   P   R   L   L   I   Y   G
103     GCC TGG TAC CAG CAG AAA CCT GGC CAG GCT CCC AGG CTC CTC ATC TAT GGT

___CDR2_____
        A   S   S   R   A   T   G   I   P   D   R   F   S   G   S   G   S
154     GCA TCC AGC AGG GCC ACT GGC ATC CCA GAC AGG TTC AGT GGC AGT GGG TCT

G   T   D   F   T   L   T   I   S   R   L   E   P   E   D   F   A
205     GGG ACA GAC TTC ACT CTC ACC ATC AGC AGA CTG GAG CCT GAA GAT TTT GCA

_CDR3_____
        V   Y   Y   C   Q   Q   Y   G   S   S   L   T   F   G   G   G   T
256     GTG TAT TAC TGT CAG CAG TAT GGT AGC TCA CTC ACT TTC GGC GGA GGG ACC

K   V   E   I   K
307     AAG GTG GAG ATC AAA
```

FIG. 5D

Anti-TIM-3 9F6 VK3

V segment: A27

J segment: JK4

```
        E    I    V    L    T    Q    S    P    G    T    L    S    L    S    P    G    E
1       GAA  ATT  GTG  TTG  ACG  CAG  TCT  CCA  GGC  ACC  CTG  TCT  TTG  TCT  CCA  GGG  GAA

_CDR1_____
        R    A    T    L    S    C    R    A    S    Q    S    V    S    S    S    Y    L
52      AGA  GCC  ACC  CTC  TCC  TGC  AGG  GCC  AGT  CAG  AGT  GTT  AGC  AGC  AGC  TAC  TTA

___
        A    W    Y    Q    Q    K    P    G    Q    A    P    R    L    L    I    Y    G
103     GCC  TGG  TAC  CAG  CAG  AAA  CCT  GGC  CAG  GCT  CCC  AGG  CTC  CTC  ATC  TAT  GGT

____CDR2_____
        A    S    S    R    A    T    G    I    P    D    R    F    S    G    S    G    S
154     GCA  TCC  AGC  AGG  GCC  ACT  GGC  ATC  CCA  GAC  AGG  TTC  AGT  GGC  AGT  GGG  TCT

G    T    D    F    T    L    T    I    S    R    L    E    P    E    D    F    A
205     GGG  ACA  GAC  TTC  ACT  CTC  ACC  ATC  AGC  AGA  CTG  GAG  CCT  GAA  GAT  TTT  GCA

_CDR3_____
        V    Y    Y    C    Q    Q    Y    G    S    S    P    L    T    F    G    G    G
256     GTG  TAT  TAC  TGT  CAG  CAG  TAT  GGT  AGC  TCA  CCG  CTC  ACT  TTC  GGC  GGA  GGG

T    K    V    E    I    K
307     ACC  AAG  GTG  GAG  ATC  AAA
```

TGGAGTTTGGGCTGAGCTGGGTTTTCCTTGTTGCTATTATAAAAGGTGTCCAGTGTCAGGTGCAGCTGGTGGAGT
CTGGGGGAGGCTTGGTCAAGCCTGGAGGGTCCCTGAGACTCTCCTGTGCAGCCTCTGGATTCACCTTCAGTGACT
ACTACATGAGCTGGATCCGCCAGGCTCCAGGGAAGGGGCTGGAGTGGGTTTCATTCATTAGTGGTGGTGGTAGTA
CCATATACTACGCAGACTCTGTGAAGGGCCGATTCACCATCTCCAGGGACAACGCCAAGAACTCGCTGTTTCTGC
AAATGAACAGCCTGAGAGTCGAGGACACGGCTGTGTATTACTGTGCGAGAGATGGCTATAGCAGTGGCTGGTACT
ACTACGGTATGGACGTCTGGGGCCAAGGGACCGCGGTCACCGTCTCCTCA

9F6_AA_VH1

MEFGLSWVFLVAIIKGVQCQVQLVESGGGLVKPGGSLRLSCAASGFTFSDYYMSWIRQAPGKGLEWVSFISGGGS
TIYYADSVKGRFTISRDNAKNSLFLQMNSLRVEDTAVYYCARDGYSSGWYYYGMDVWGQGTAVTVSS

9F6_NT_VK1

ATGGACATGAGGGTCCCCGCTCAGCTCCTGGGGCTTCTGCTGCTCTGGCTCCCAGGTGCCAGATGTGCCATCCAG
TTGACCCAGTCTCCATCCTCCCTGTCTGCATCTGTAGGAGACAGAGTCACCATCACTTGCCGGGCAAGTCAGGGC
ATTAGCAGTGCTTTAGCCTGGTATCAGCAGAAACCAGGGAAAGCTCCTAAGCTCCTGATCTATGATGCCTCCAGT
TTGGAAAGTGGGGTCCCATCAAGGTTCAGCGGCAGTGGATCTGGGACAGATTTCACTCTCACCATCAGCAGCCTG
CAGCCTGAAGATTTTGCAACTTATTACTGTCAACAGTTTAATAGTTACCCTCGGACGTTCGGCCAAGGGACCAAG
GTGGAAATCAAA

9F6_AA_VK1

MDMRVPAQLLGLLLLWLPGARCAIQLTQSPSSLSASVGDRVTITCRASQGISSALAWYQQKPGKAPKLLIYDASS
LESGVPSRFSGSGSGTDFTLTISSLQPEDFATYYCQQFNSYPRTFGQGTKVEIK

9F6_NT_VK2

ATGGAAACCCCAGCGCAGCTTCTCTTCCTCCTGCTACTCTGGCTCCCAGATACCACCGGAGAAATTGTGTTGACG
CAGTCTCCAGGCACCCTGTCTTTGTCTCCAGGGGAAAGAGCCACCCTCTCCTGCAGGGCCAGTCAGAGTGTTAGC
AGCAGCTACTTAGCCTGGTACCAGCAGAAACCTGGCCAGGCTCCCAGGCTCCTCATCTATGGTGCATCCAGCAGG
GCCACTGGCATCCCAGACAGGTTCAGTGGCAGTGGGTCTGGGACAGACTTCACTCTCACCATCAGCAGACTGGAG
CCTGAAGATTTTGCAGTGTATTACTGTCAGCAGTATGGTAGCTCACTCACTTTCGGCGGAGGGACCAAGGTGGAG
ATCAAA

9F6_AA_VK2

METPAQLLFLLLLWLPDTTGEIVLTQSPGTLSLSPGERATLSCRASQSVSSSYLAWYQQKPGQAPRLLIYGASSR
ATGIPDRFSGSGSGTDFTLTISRLEPEDFAVYYCQQYGSSLTFGGGTKVEIK

9F6_NT_VK3

ATGGAAACCCCAGCGCAGCTTCTCTTCCTCCTGCTACTCTGGCTCCCAGATACCACCGGAGAAATTGTGTTGACG
CAGTCTCCAGGCACCCTGTCTTTGTCTCCAGGGGAAAGAGCCACCCTCTCCTGCAGGGCCAGTCAGAGTGTTAGC
AGCAGCTACTTAGCCTGGTACCAGCAGAAACCTGGCCAGGCTCCCAGGCTCCTCATCTATGGTGCATCCAGCAGG
GCCACTGGCATCCCAGACAGGTTCAGTGGCAGTGGGTCTGGGACAGACTTCACTCTCACCATCAGCAGACTGGAG
CCTGAAGATTTTGCAGTGTATTACTGTCAGCAGTATGGTAGCTCACCGCTCACTTTCGG
CGGAGGGACCAAGGTGGAGATCAAA

9F6_AA_VK3

METPAQLLFLLLLWLPDTTGEIVLTQSPGTLSLSPGERATLSCRASQSVSSSYLAWYQQKPGQAPRLLIYGASSR
ATGIPDRFSGSGSGTDFTLTISRLEPEDFAVYYCQQYGSSPLTFGGGTKVEIK

FIG. 6A

Anti-TIM-3 3G4 VH1

V segment: 3-11

D segment: 6-13

J segment: JH6b

```
         Q   V   Q   L   V   E   S   G   G   G   L   V   K   P   G   G   S
1        CAG GTG CAG CTG GTG GAG TCT GGG GGA GGC TTG GTC AAG CCT GGA GGG TCC

___CDR1_____
         L   R   L   S   C   A   A   S   G   F   T   F   S   D   Y   Y   M
52       CTG AGA CTC TCC TGT GCA GCC TCT GGA TTC ACC TTC AGT GAC TAC TAC ATG

___                                                       ___CDR2__
         S   W   I   R   Q   A   P   G   K   G   L   E   W   V   S   F   I
103      AGC TGG ATC CGC CAG GCT CCA GGG AAG GGG CTG GAG TGG GTT TCA TTC ATT

S   T   S   G   S   I   I   Y   Y   A   D   S   V   K   G   R   F
154      AGT ACT AGT GGT AGT ATC ATA TAC TAC GCA GAC TCT GTG AAG GGC CGA TTC

T   I   S   R   D   N   A   K   N   S   L   Y   L   Q   M   N   S
205      ACC ATC TCC AGG GAC AAC GCC AAG AAC TCA CTG TAT CTG CAA ATG AAC AGC

___CDR3_____
         L   R   A   E   D   T   A   V   Y   Y   C   A   R   E   G   Y   S
256      CTG AGA GCC GAG GAC ACG GCT GTG TAT TAC TGT GCG AGA GAA GGG TAT AGC

S   S   W   S   Y   Y   Y   G   M   D   V   W   G   Q   G   T   T
307      AGC AGC TGG TCC TAC TAC TAC GGT ATG GAC GTC TGG GGC CAA GGG ACC ACG

V   T   V   S   S
358      GTC ACC GTC TCC TCA
```

FIG. 6B

Anti-TIM-3 3G4 VK1

V segment: A27

J segment: JK5

```
          E   I   V   L   T   Q   S   P   G   T   L   S   L   S   P   G   E
  1      GAA ATT GTG TTG ACG CAG TCT CCA GGC ACC CTG TCT TTG TCT CCA GGG GAA

_CDR1_____
          R   A   T   L   S   C   R   A   S   Q   S   V   S   S   S   Y   L
 52      AGA GCC ACC CTC TCC TGC AGG GCC AGT CAG AGT GTT AGC AGC AGC TAC TTA

___
          A   W   Y   Q   Q   K   P   G   Q   A   P   R   L   L   I   Y   G
103      GCC TGG TAC CAG CAG AAA CCT GGC CAG GCT CCC AGG CTC CTC ATC TAT GGT

____CDR2_____
          A   S   S   R   A   T   G   I   P   D   R   F   S   G   S   G   S
154      GCA TCC AGC AGG GCC ACT GGC ATC CCA GAC AGG TTC AGT GGC AGT GGG TCT

G   T   D   F   T   L   T   I   S   R   L   E   P   E   D   F   A
205      GGG ACA GAC TTC ACT CTC ACC ATC AGC AGA CTG GAG CCT GAA GAT TTT GCA

_CDR3_____
          V   Y   Y   C   Q   Q   Y   G   S   P   I   T   F   G   Q   G
256      GTG TAT TAC TGT CAG CAG TAT GGT AGC TCA CCG ATC ACC TTC GGC CAA GGG

T   R   L   E   I   K
307      ACA CGA CTG GAG ATT AAA
```

ATGGAGTTTGGGCTGAGCTGGGTTTTCCTTGTTGCTATTATAAAAGGTGTCCAGTGTCAGGTGCAGCTGGTGGAG
TCTGGGGGAGGCTTGGTCAAGCCTGGAGGGTCCCTGAGACTCTCCTGTGCAGCCTCTGGATTCACCTTCAGTGAC
TACTACATGAGCTGGATCCGCCAGGCTCCAGGGAAGGGGCTGGAGTGGGTTTCATTCATTAGTACTAGTGGTAGT
ATCATATACTACGCAGACTCTGTGAAGGGCCGATTCACCATCTCCAGGGACAACGCCAAGAACTCACTGTATCTG
CAAATGAACAGCCTGAGAGCCGAGGACACGGCTGTGTATTACTGTGCGAGAGAAGGGTATAGCAGCAGCTGGTCC
TACTACTACGGTATGGACGTCTGGGGCCAAGGGACCACGGTCACCGTCTCCTCA

3G4_AA_VH1

MEFGLSWVFLVAIIKGVQCQVQLVESGGGLVKPGGSLRLSCAASGFTFSDYYMSWIRQAPGKGLEWVSFISTSGS
IIYYADSVKGRFTISRDNAKNSLYLQMNSLRAEDTAVYYCAREGYSSSWSYYYGMDVWGQGTTVTVSS

3G4_NT_VK1

ATGGAAACCCCAGCGCAGCTTCTCTTCCTCCTGCTACTCTGGCTCCCAGATACCACCGGAGAAATTGTGTTGACG
CAGTCTCCAGGCACCCTGTCTTTGTCTCCAGGGGAAAGAGCCACCCTCTCCTGCAGGGCCAGTCAGAGTGTTAGC
AGCAGCTACTTAGCCTGGTACCAGCAGAAACCTGGCCAGGCTCCCAGGCTCCTCATCTATGGTGCATCCAGCAGG
GCCACTGGCATCCCAGACAGGTTCAGTGGCAGTGGGTCTGGGACAGACTTCACTCTCACCATCAGCAGACTGGAG
CCTGAAGATTTTGCAGTGTATTACTGTCAGCAGTATGGTAGCTCACCGATCACCTTCGGCCAAGGGACACGACTG
GAGATTAAA

3G4_AA_VK1

METPAQLLFLLLLWLPDTTGEIVLTQSPGTLSLSPGERATLSCRASQSVSSSYLAWYQQKPGQAPRLLIYGASSR
ATGIPDRFSGSGSGTDFTLTISRLEPEDFAVYYCQQYGSSPITFGQGTRLEIK

FIG. 7A

Anti-TIM-3 17C8 VH1

V segment: 3-11

D segment: 6-19

J segment: JH6b

```
          Q   V   Q   L   V   E   S   G   G   G   L   V   K   P   G   G   S
1         CAG GTG CAG CTG GTG GAG TCT GGG GGA GGC TTG GTC AAG CCT GGA GGG TCC

▁CDR1▁▁▁▁▁▁
          L   R   L   S   C   A   A   S   G   F   T   F   S   D   Y   Y   M
52        CTG AGA CTC TCC TGT GCA GCC TCT GGA TTC ACC TTC AGT GAC TAC TAC ATG

▔
          S   W   I   R   Q   A   P   G   K   G   L   E   W   V   S   F   I
103       AGC TGG ATC CGC CAG GCT CCA GGG AAG GGG CTG GAG TGG GTT TCA TTC ATT

▁▁▁▁▁▁CDR2▁
          S   S   S   G   S   I   I   Y   Y   A   D   S   V   K   G   R   F
154       AGT AGT AGT GGT AGT ATC ATA TAC TAC GCA GAC TCT GTG AAG GGC CGA TTC

T   I   S   R   D   N   A   K   N   S   L   Y   L   Q   M   N   S
205       ACC ATC TCC AGG GAC AAC GCC AAG AAC TCA CTG TAT CTG CAA ATG AAC AGC

▁CDR3▁▁▁▁▁▁▁▁
          L   R   A   E   D   T   A   V   Y   Y   C   A   R   D   G   Y   S
256       CTG AGA GCC GAG GAC ACG GCT GTG TAT TAC TGT GCG AGA GAT GGG TAT AGC

▔▔▔▔▔▔
          S   G   W   E   Y   Y   G   M   D   V   W   G   Q   G   T   T   V
307       AGT GGC TGG GAG TAC TAC GGT ATG GAC GTC TGG GGC CAA GGG ACC ACG GTC

T   V   S   S
358       ACC GTC TCC TCA
```

FIG. 7B

Anti-TIM-3 17C8 VK1

V segment: A27

J segment: JK4

```
         E   I   V   L   T   Q   S   P   G   T   L   S   L   S   P   G   E
1        GAA ATT GTG TTG ACG CAG TCT CCA GGC ACC CTG TCT TTG TCT CCA GGG GAA

_CDR1_____
         R   A   T   L   S   C   R   A   S   Q   S   V   S   S   S   Y   L
52       AGA GCC ACC CTC TCC TGC AGG GCC AGT CAG AGT GTT AGC AGC AGC TAC TTA

___
         A   W   Y   Q   Q   K   P   G   Q   A   P   R   L   L   I   Y   G
103      GCC TGG TAC CAG CAG AAA CCT GGC CAG GCT CCC AGG CTC CTC ATC TAT GGT

_CDR2_____
         A   S   S   R   A   T   G   I   P   D   R   F   S   G   S   G   S
154      GCA TCC AGC AGG GCC ACT GGC ATC CCA GAC AGG TTC AGT GGC AGT GGG TCT

G   T   D   F   T   L   T   I   S   R   L   E   P   E   D   F   A
205      GGG ACA GAC TTC ACT CTC ACC ATC AGC AGA CTG GAG CCT GAA GAT TTT GCA

_CDR3_____
         V   Y   Y   C   Q   Q   Y   G   S   S   P   L   T   F   G   G   G
256      GTG TAT TAC TGT CAG CAG TAT GGT AGC TCA CCG CTC ACT TTC GGC GGA GGG

T   K   V   E   I   K
307      ACC AAG GTG GAG ATC AAA
```

ATGGAGTTTGGGCTGAGCTGGGTTTTCCTTGTTGCTATTATAAAAGGTGTCCAGTGTCAGGTGCAGCTGGTGGAG
TCTGGGGGAGGCTTGGTCAAGCCTGGAGGGTCCCTGAGACTCTCCTGTGCAGCCTCTGGATTCACCTTCAGTGAC
TACTACATGAGCTGGATCCGCCAGGCTCCAGGGAAGGGGCTGGAGTGGGTTTCATTCATTAGTAGTAGTGGTAGT
ATCATATACTACGCAGACTCTGTGAAGGGCCGATTCACCATCTCCAGGGACAACGCCAAGAACTCACTGTATCTG
CAAATGAACAGCCTGAGAGCCGAGGACACGGCTGTGTATTACTGTGCGAGAGATGGGTATAGCAGTGGCTGGGAG
TACTACGGTATGGACGTCTGGGGCCAAGGGACCACGGTCACCGTCTCCTCA

17C8_AA_VH1

MEFGLSWVFLVAIIKGVQCQVQLVESGGGLVKPGGSLRLSCAASGFTFSDYYMSWIRQAPGKGLEWVSFISSSGS
IIYYADSVKGRFTISRDNAKNSLYLQMNSLRAEDTAVYYCARDGYSSGWEYYGMDVWGQGTTVTVSS

17C8_NT_VK1

ATGGAAACCCCAGCGCAGCTTCTCTTCCTCCTGCTACTCTGGCTCCCAGATACCACCGGAGAAATTGTGTTGACG
CAGTCTCCAGGCACCCTGTCTTTGTCTCCAGGGGAAAGAGCCACCCTCTCCTGCAGGGCCAGTCAGAGTGTTAGC
AGCAGCTACTTAGCCTGGTACCAGCAGAAACCTGGCCAGGCTCCCAGGCTCCTCATCTATGGTGCATCCAGCAGG
GCCACTGGCATCCCAGACAGGTTCAGTGGCAGTGGGTCTGGGACAGACTTCACTCTCACCATCAGCAGACTGGAG
CCTGAAGATTTTGCAGTGTATTACTGTCAGCAGTATGGTAGCTCACCGCTCACTTTCGGCGGAGGGACCAAGGTG
GAGATCAAA

17C8_AA_VK1

METPAQLLFLLLLWLPDTTGEIVLTQSPGTLSLSPGERATLSCRASQSVSSSYLAWYQQKPGQAPRLLIYGASSR
ATGIPDRFSGSGSGTDFTLTISRLEPEDFAVYYCQQYGSSPLTFGGGTKVEIK

FIG. 8A

Anti-TIM-3 14H7 VH1

V segment: 3-11

D segment: 4-23

J segment: JH4b

```
      Q   V   H   L   V   E   S   G   G   G   L   V   K   P   G   G   S
1     CAG GTG CAC CTG GTG GAG TCT GGG GGA GGC TTG GTC AAG CCT GGA GGG TCC

CDR1
      L   R   L   S   C   T   A   F   S   D   Y   Y   M   S   W   I   R
52    CTG AGA CTC TCC TGT ACA GCC TTC AGT GAC TAC TAC ATG AGC TGG ATC CGC

CDR2
      Q   A   P   G   K   G   L   E   W   L   S   Y   I   S   N   S   G
103   CAG GCT CCA GGG AAG GGG CTG GAG TGG TTA TCA TAC ATT AGT AAT AGT GGT

S   I   I   Y   Y   A   D   S   V   K   G   R   F   T   I   S   R
154   AGT ATC ATA TAC TAC GCA GAC TCT GTG AAG GGC CGA TTC ACC ATC TCC AGG

D   N   A   K   N   S   V   Y   L   Q   M   N   S   L   R   A   E
205   GAC AAC GCC AAG AAC TCA GTG TAT CTG CAA ATG AAC AGC CTG AGA GCC GAG

CDR3
      D   T   A   V   Y   Y   C   A   R   G   R   I   G   F   F   D   Y
256   GAC ACG GCT GTG TAT TAC TGT GCG AGA GGG CGA ATT GGT TTT TTT GAC TAC

W   G   P   G   T   L   V   T   V   S   S
307   TGG GGC CCG GGA ACC CTG GTC ACC GTC TCC TCA
```

FIG. 8B

Anti-TIM-3 14H7 VK1

V segment: A27

J segment: JK3

```
         E   I   V   L   T   Q   S   P   G   T   L   S   L   S   P   G   E
1        GAA ATT GTG TTG ACG CAG TCT CCA GGC ACC CTG TCT TTG TCT CCA GGG GAA

_CDR1_____
         R   A   T   L   S   C   R   A   S   Q   S   V   S   S   S   Y   L
52       AGA GCC ACC CTC TCC TGC AGG GCC AGT CAG AGT GTT AGC AGC AGC TAC TTA

_____
         A   W   Y   Q   Q   K   P   G   Q   A   P   R   L   L   I   Y   G
103      GCC TGG TAC CAG CAG AAA CCT GGC CAG GCT CCC AGG CTC CTC ATC TAT GGT

_CDR2_____
         A   S   S   R   A   T   G   I   P   D   R   F   S   G   S   G   S
154      GCA TCC AGC AGG GCC ACT GGC ATC CCA GAC AGG TTC AGT GGC AGT GGG TCT

G   T   D   F   T   L   T   I   S   R   L   E   P   E   D   F   A
205      GGG ACA GAC TTC ACT CTC ACC ATC AGC AGA CTG GAG CCT GAA GAT TTT GCA

_CDR3_____
         V   Y   Y   C   Q   Q   Y   G   S   S   P   L   T   F   G   P   G
256      GTG TAT TAC TGT CAG CAG TAT GGT AGC TCA CCT CTC ACT TTC GGC CCT GGG

T   K   V   D   I   K
307      ACC AAA GTG GAT ATC AAA
```

FIG. 8C

14H7_NT_VH1
ATGAGGGCTTGGATCTTCTTTCTGCTCTGCCTGGCCGGGAGAGCGCTCGCACAGGTGCACCTGGTGGAGTCTGGG
GGAGGCTTGGTCAAGCCTGGAGGGTCCCTGAGACTCTCCTGTACAGCCTTCAGTGACTACTACATGAGCTGGATC
CGCCAGGCTCCAGGGAAGGGGCTGGAGTGGTTATCATACATTAGTAATAGTGGTAGTATCATATACTACGCAGAC
TCTGTGAAGGGCCGATTCACCATCTCCAGGGACAACGCCAAGAACTCAGTGTATCTGCAAATGAACAGCCTGAGA
GCCGAGGACACGGCTGTGTATTACTGTGCGAGAGGGCGAATTGGTTTTTTTGACTACTGGGGCCCGGGAACCCTG
GTCACCGTCTCCTCA

14H7_AA_VH1
MRAWIFFLLCLAGRALAQVHLVESGGGLVKPGGSLRLSCTAFSDYYMSWIRQAPGKGLEWLSYISNSGSIIYYAD
SVKGRFTISRDNAKNSVYLQMNSLRAEDTAVYYCARGRIGFFDYWGPGTLVTVSS

14H7_NT_VK1
ATGAGGGCTTGGATCTTCTTTCTGCTCTGCCTGGCCGGGCGCGCCTTGGCCGAAATTGTGTTGACGCAGTCTCCA
GGCACCCTGTCTTTGTCTCCAGGGGAAAGAGCCACCCTCTCCTGCAGGGCCAGTCAGAGTGTTAGCAGCAGCTAC
TTAGCCTGGTACCAGCAGAAACCTGGCCAGGCTCCCAGGCTCCTCATCTATGGTGCATCCAGCAGGGCCACTGGC
ATCCCAGACAGGTTCAGTGGCAGTGGGTCTGGGACAGACTTCACTCTCACCATCAGCAGACTGGAGCCTGAAGAT
TTTGCAGTGTATTACTGTCAGCAGTATGGTAGCTCACCTCTCACTTTCGGCCCTGGGACCAAAGTGGATATCAAA

14H7_AA_VK1
MRAWIFFLLCLAGRALAEIVLTQSPGTLSLSPGERATLSCRASQSVSSSYLAWYQQKPGQAPRLLIYGASSRATG
IPDRFSGSGSGTDFTLTISRLEPEDFAVYYCQQYGSSPLTFGPGTKVDIK

FIG. 9A

Anti-TIM-3 23B3 VH1

V segment: 3-11

D segment: 3-10

J segment: JH6b

```
       Q   V   Q   L   V   G   S   G   G   G   L   V   K   P   G   G   S
  1    CAG GTG CAG CTG GTG GGA TCT GGG GGA GGC TTG GTC AAG CCT GGA GGG TCC

_CDR1_____
       L   R   L   S   C   A   A   S   G   F   T   F   S   D   Y   Y   M
 52    CTG AGA CTC TCC TGT GCA GCC TCT GGA TTC ACC TTC AGT GAC TAC TAC ATG

___                                                    _CDR2__
       S   W   I   R   Q   A   P   G   K   G   L   E   W   V   S   F   I
103    AGC TGG ATC CGC CAG GCT CCA GGG AAG GGG CTG GAA TGG GTT TCA TTC ATT

S   G   S   G   S   I   I   Y   Y   A   D   S   V   K   G   R   F
154    AGT GGT AGT GGT AGT ATC ATA TAC TAC GCA GAC TCT GTG AAG GGC CGA TTC

T   I   S   R   D   N   A   K   N   S   L   D   L   Q   M   N   S
205    ACC ATC TCC AGG GAC AAC GCC AAG AAC TCA CTG GAT CTG CAA ATG AAC AGC

_CDR3_____
       L   R   A   E   D   T   A   V   Y   Y   C   A   R   D   G   M   V
256    CTG AGA GCC GAG GAC ACG GCT GTG TAT TAC TGT GCG AGA GAC GGT ATG GTT

R   G   M   N   F   Y   G   M   D   V   W   G   Q   G   T   T   V
307    CGG GGA ATG AAC TTC TAC GGT ATG GAC GTC TGG GGC CAA GGG ACC ACG GTC

T   V   S   S
358    ACC GTC TCC TCA
```

FIG. 9B

Anti-TIM-3 23B3 VK1

V segment: A27

J segment: JK5

```
         E   I   V   L   T   Q   S   P   G   T   L   S   L   S   P   G   E
1        GAA ATT GTG TTG ACG CAG TCT CCA GGC ACC CTG TCT TTG TCT CCA GGG GAA

_CDR1_____
         R   A   T   L   S   C   R   A   S   Q   S   V   S   S   S   Y   L
52       AGA GCC ACC CTC TCC TGC AGG GCC AGT CAG AGT GTT AGC AGC AGC TAC TTA

A   W   Y   Q   Q   K   P   G   Q   A   P   R   L   L   I   Y   G
103      GCC TGG TAC CAG CAG AAA CCT GGC CAG GCT CCC AGG CTC CTC ATC TAT GGT

__CDR2_____
         A   S   S   R   A   T   G   I   P   D   R   F   S   G   S   G   S
154      GCA TCC AGC AGG GCC ACT GGC ATC CCA GAC AGG TTC AGT GGC AGT GGG TCT

G   T   D   F   T   L   T   I   S   R   L   E   P   E   D   F   A
205      GGG ACA GAC TTC ACT CTC ACC ATC AGC AGA CTG GAG CCT GAA GAT TTT GCA

_CDR3_____
         V   Y   Y   C   Q   Q   Y   G   S   S   P   I   T   F   G   Q   G
256      GTG TAT TAC TGT CAG CAG TAT GGT AGC TCA CCG ATC ACC TTC GGC CAA GGG

T   R   L   E   I   K
307      ACA CGA CTG GAG ATT AAA
```

FIG. 9C

Anti-TIM-3 23B3 VK2

V segment: A27

J segment: JK4

```
          E   I   V   L   T   Q   S   P   G   T   L   S   L   S   P   G   E
1         GAA ATT GTG TTG ACG CAG TCT CCA GGC ACC CTG TCT TTG TCT CCA GGG GAA

_CDR1_____
          R   A   T   L   S   C   R   A   S   Q   S   V   S   S   S   Y   L
52        AGA GCC ACC CTC TCC TGC AGG GCC AGT CAG AGT GTT AGC AGC AGC TAC TTA

A   W   Y   Q   Q   K   P   G   Q   A   P   R   L   L   I   Y   G
103       GCC TGG TAC CAG CAG AAA CCT GGC CAG GCT CCC AGG CTC CTC ATC TAT GGT

_CDR2_____
          A   S   S   R   A   T   G   I   P   D   R   F   S   G   S   G   S
154       GCA TCC AGC AGG GCC ACT GGC ATC CCA GAC AGG TTC AGT GGC AGT GGG TCT

G   T   D   F   T   L   T   I   S   R   L   E   P   E   D   F   A
205       GGG ACA GAC TTC ACT CTC ACC ATC AGC AGA CTG GAG CCT GAA GAT TTT GCA

_CDR3_____
          V   Y   Y   C   Q   Q   Y   G   S   S   P   F   G   G   G   T   K
256       GTG TAT TAC TGT CAG CAG TAT GGT AGC TCA CCT TTC GGC GGA GGG ACC AAG

V   E   I   K
307       GTG GAG ATC AAA
```

FIG. 9D

23B3_NT_VH1
ATGAGGGCTTGGATCTTCTTTCTGCTCTGCCTGGCCGGGAGAGCGCTCGCACAGGTGCAGCTGGTGGGATCTGGG
GGAGGCTTGGTCAAGCCTGGAGGGTCCCTGAGACTCTCCTGTGCAGCCTCTGGATTCACCTTCAGTGACTACTAC
ATGAGCTGGATCCGCCAGGCTCCAGGGAAGGGGCTGGAATGGGTTTCATTCATTAGTGGTAGTGGTAGTATCATA
TACTACGCAGACTCTGTGAAGGGCCGATTCACCATCTCCAGGACAACGCCAAGAACTCACTGGATCTGCAAATG
AACAGCCTGAGAGCCGAGGACACGGCTGTGTATTACTGTGCGAGAGACGGTATGGTTCGGGGAATGAACTTCTAC
GGTATGGACGTCTGGGGCCAAGGGACCACGGTCACCGTCTCCTCA

23B3_AA_VH1
MRAWIFFLLCLAGRALAQVQLVGSGGGLVKPGGSLRLSCAASGFTFSDYYMSWIRQAPGKGLEWVSFISGSGSII
YYADSVKGRFTISRDNAKNSLDLQMNSLRAEDTAVYYCARDGMVRGMNFYGMDVWGQGTTVTVSS

23B3_NT_VK1
ATGAGGGCTTGGATCTTCTTTCTGCTCTGCCTGGCCGGGCGCGCCTTGGCCGAAATTGTGTTGACGCAGTCTCCA
GGCACCCTGTCTTTGTCTCCAGGGGAAAGAGCCACCCTCTCCTGCAGGGCCAGTCAGAGTGTTAGCAGCAGCTAC
TTAGCCTGGTACCAGCAGAAACCTGGCCAGGCTCCCAGGCTCCTCATCTATGGTGCATCCAGCAGGGCCACTGGC
ATCCCAGACAGGTTCAGTGGCAGTGGGTCTGGGACAGACTTCACTCTCACCATCAGCAGACTGGAGCCTGAAGAT
TTTGCAGTGTATTACTGTCAGCAGTATGGTAGCTCACCGATCACCTTCGGCCAAGGGACACGACTGGAGATTAAA

23B3_AA_VK1
MRAWIFFLLCLAGRALAEIVLTQSPGTLSLSPGERATLSCRASQSVSSSYLAWYQQKPGQAPRLLIYGASSRATG
IPDRFSGSGSGTDFTLTISRLEPEDFAVYYCQQYGSSPITFGQGTRLEIK

23B3_NT_VK2
ATGAGGGCTTGGATCTTCTTTCTGCTCTGCCTGGCCGGGCGCGCCTTGGCCGAAATTGTGTTGACGCAGTCTCCA
GGCACCCTGTCTTTGTCTCCAGGGGAAAGAGCCACCCTCTCCTGCAGGGCCAGTCAGAGTGTTAGCAGCAGCTAC
TTAGCCTGGTACCAGCAGAAACCTGGCCAGGCTCCCAGGCTCCTCATCTATGGTGCATCCAGCAGGGCCACTGGC
ATCCCAGACAGGTTCAGTGGCAGTGGGTCTGGGACAGACTTCACTCTCACCATCAGCAGACTGGAGCCTGAAGAT
TTTGCAGTGTATTACTGTCAGCAGTATGGTAGCTCACCTTTCGGCGGAGGGACCAAGGTGGAGATCAAA

23B3_AA_VK2
MRAWIFFLLCLAGRALAEIVLTQSPGTLSLSPGERATLSCRASQSVSSSYLAWYQQKPGQAPRLLIYGASSRATG
IPDRFSGSGSGTDFTLTISRLEPEDFAVYYCQQYGSSPFGGGTKVEIK

FIG. 10A

Sequence Alignment for Heavy Chain Variable Regions

```
                    FR1                    CDR1           FR2         CDR2
13A3    QLQLQESGPGLVKPSETLSLTCTVSGGSIS SRSYYWG WIRQPPGKGLEWIG SIYYSGFT-    59
8B9     QVQLQESGPGLVKPSETLSLTCTVSGGSIS --RHYWN WIRQPPGKGLEWIG YIHYSGST-    57
8C4     QVQLQESGPGLVKPSETLSLTCTVSGGSIS --RYYWS WIRQPPGKGLEWIG YIHYTGST-    57
17C3    QVQLVQSGAEVKKPGASVKVSCKASGYTFT --SYYMH WVRQAPGQGLEWMG IINPRGDSI    58
9F6     QVQLVESGGGLVKPGGSLRLSCAASGFTFS --DYYMS WIRQAPGKGLEWVS FISGGGSTI    58
3G4     QVQLVESGGGLVKPGGSLRLSCAASGFTFS --DYYMS WIRQAPGKGLEWVS FISTSGSII    58
17C8    QVQLVESGGGLVKPGGSLRLSCAASGFTFS --DYYMS WIRQAPGKGLEWVS FISSSGSII    58
23B3    QVQLVGSGGGLVKPGGSLRLSCAASGFTFS --DYYMS WIRQAPGKGLEWVS FISGSGSII    58
14H7    QVHLVESGGGLVKPGGSLRLSCTA------FS --DYYMS WIRQAPGKGLEWLS YISNSGSII    54
        *:*   **   **.  ::  ::*  ,      ::     ;*   *;**,**;****;.  *   *

CDR2                   FR3                              CDR3
13A3    YYNPSLKS RVTISVDTSKNQFSLKLSSVTAADTAVYYCAT ----GG---PYGDYAHWFDP   112
8B9     NYNSSLKS RVTISVDTSKNQFSLKLSSVTAADTAVYYCAR D---TG---YYG-----MDI    106
8C4     NYNPSLKS RVTISVDTSKNQFSLKLSSVTAADTAVYYCAT D---TG---YYG-----MDV    106
17C3    IYAQKFQG RVTMTRDTSTSTVYMELSSLRSEDTAVYYCAR DFYGSGNY-YYG-----MDV    112
9F6     YYADSVKG RFTISRDNAKNSLFLQMNSLRVEDTAVYYCAR DGYSSGWY-YYG-----MDV    112
3G4     YYADSVKG RFTISRDNAKNSLYLQMNSLRAEDTAVYYCAR EGYSSSWSYYYG-----MDV    113
17C8    YYADSVKG RFTISRDNAKNSLYLQMNSLRAEDTAVYYCAR DGYSSGWE-YYG------MDV   112
23B3    YYADSVKG RFTISRDNAKNSLDLQMNSLRAEDTAVYYCAR DGMVRGMN-FYG------MDV   112
14H7    YYADSVKG RFTISRDNAKNSVYLQMNSLRAEDTAVYYCAR GRIG------FF---------DY 102
         *   ..:.*.*::  *.:..  .  :::.*;     *******          :        *

FR4
13A3    WGQGTLVTVSS    123
8B9     WGQGTTVTVSS    117
8C4     WGQGTTVTVSS    117
17C3    WGQGTTVTVSS    123
9F6     WGQGTAVTVSS    123
3G4     WGQGTTVTVSS    124
17C8    WGQGTTVTVSS    123
23B3    WGQGTTVTVSS    123
14H7    WGPGTLVTVSS    113
        **  ** *****
```

FIG. 10B

VH Region Sequence Designation

| | SEQ ID NO: | | | | | | | | |
|---|---|---|---|---|---|---|---|---|---|
| | VH | CDR1 | CDR2 | CDR3 | VH Variants | | | | |
| 13A3. | 34 | 41 | 46 | 53 | 112 (N60Q) | 113 (N60S) | 114 (N60A) | 115 (D101E) | 116 (P102V) |
| | | | | | 117 (P102Y) | 118 (P102L) | 119 (N60Q, P102Y) | 364 (N60Q, D101E) | |
| 8B9. | 35 | 42 | 47 | 54 | 120 (S61P) | | | | |
| 8C4. | 36 | 43 | 48 | 55 | | | | | |
| 17C3. | 37 | 44 | 49 | 56 | | | | | |
| 9F6. | 38 | 45 | 50 | 57 | 121 (A108T) | | | | |
| 3G4. | 39 | 45 | 51 | 58 | | | | | |
| 17C8. | 40 | 45 | 52 | 59 | | | | | |
| 14H7 | 410 | 45 | 413 | 414 | | | | | |
| 23B3 | 411 | 45 | 415 | 416 | 412 (G6E, D79Y) | | | | |

FIG. 11A

Sequence Alignment for Light Chain Variable Regions

```
                        FR1              CDR1            FR2         CDR2
13A3       EIVLTQSPGTLSLSPGERATLSC RASQSVSSSYLA WYQQKPGQAPRLLIY GASSRAT GIP  60
8B9        EIVLTQSPGTLSLSPGERATLSC RASQSVSSSYLA WYQQKPGQAPRLLIY GASSRAT GIP  60
8C4        EIVLTQSPGTLSLSPGERATLSC RASQSVSSSYLA WYQQKPGQAPRLLIY GASSRAT GIP  60
17C3       EIVLTQSPGTLSLSPGERATLSC RASQSVSSSYLA WYQQKPGQAPRLLIY GASSRAT GIP  60
9F6_VK1    AIQLTQSPSSLSASVGDRVTITC RASQGISSA-LA WYQQKPGKAPKLLIY DASSLES GVP  59
9F6_VK2    EIVLTQSPGTLSLSPGERATLSC RASQGISSA-LA WYQQKPGQAPRLLIY GASSRAT GIP  60
9F6_VK3    EIVLTQSPGTLSLSPGERATLSC RASQSVSSSYLA WYQQKPGQAPRLLIY GASSRAT GIP  60
3G4        EIVLTQSPGTLSLSPGERATLSC RASQSVSSSYLA WYQQKPGQAPRLLIY GASSRAT GIP  60
17C8       EIVLTQSPGTLSLSPGERATLSC RASQSVSSSYLA WYQQKPGQAPRLLIY GASSRAT GIP  60
23B3_VK1   EIVLTQSPGTLSLSPGERATLSC RASQSVSSSYLA WYQQKPGQAPRLLIY GASSRAT GIP  60
23B3_VK2   EIVLTQSPGTLSLSPGERATLSC RASQSVSSSYLA WYQQKPGQAPRLLIY GASSRAT GIP  60
14H7       EIVLTQSPGTLSLSPGERATLSC RASQSVSSSYLA WYQQKPGQAPRLLIY GASSRAT GIP  60
             * *****.:** * *:*.*::******.:**: **********:**:**** .*** :*:*

FR3                  CDR3       FR4
13A3       DRFSGSGSGTDFTLTISRLEPEDFAVYYC QQYGSSPIT FGQGTRLEIK  108
8B9        DRFSGSGSGTDFTLTISRLEPEDFAVYYC QQYGSSPLT FGGGTKVEIK  108
8C4        DRFSGSGSGTDFTLTISRLEPEDFAVYYC QQYGSSPLT FGGGTKVEIK  108
17C3       DRFSGSGSGTDFTLTISRLEPEDFAVYYC QQYGSSPIT FGQGTRLEIK  108
9F6_VK1    SRFSGSGSGTDFTLTISSLQPEDFATYYC QQFNSYPRT FGQGTKVEIK  107
9F6_VK2    DRFSGSGSGTDFTLTISRLEPEDFAVYYC QQYGSS-LT FGGGTKVEIK  107
9F6_VK3    DRFSGSGSGTDFTLTISRLEPEDFAVYYC QQYGSSPLT FGGGTKVEIK  108
3G4        DRFSGSGSGTDFTLTISRLEPEDFAVYYC QQYGSSPIT FGQGTRLEIK  108
17C8       DRFSGSGSGTDFTLTISRLEPEDFAVYYC QQYGSSPLT FGGGTKVEIK  108
23B3_VK1   DRFSGSGSGTDFTLTISRLEPEDFAVYYC QQYGSSPIT FGQGTRLEIK  108
23B3_VK2   DRFSGSGSGTDFTLTISRLEPEDFAVYYC QQYGSSP-- FGGGTKVEIK  106
14H7       DRFSGSGSGTDFTLTISRLEPEDFAVYYC QQYGSSPLT FGPGTKVDIK  108
             .*************** *:*****.:****:.*     ** **:::**
```

FIG. 11B

Light Chain Sequence Designation

| | SEQ ID NO: | | | |
|---|---|---|---|---|
| | VL | CDR1 | CDR2 | CDR3 |
| 13A3 | 60 | 64 | 66 | 68 |
| 8B9 | 61 | 64 | 66 | 69 |
| 8C4 | 61 | 64 | 66 | 69 |
| 17C3 | 60 | 64 | 66 | 68 |
| 9F6 (VK1) | 62 | 65 | 67 | 70 |
| 9F6 (VK2) | 63 | 64 | 66 | 71 |
| 9F6 (VK3) | 61 | 64 | 66 | 69 |
| 3G4 | 60 | 64 | 66 | 68 |
| 17C8. | 61 | 64 | 66 | 69 |
| 23B3 (VK1) | 60 | 64 | 66 | 68 |
| 23B3 (VK2) | 418 | 64 | 66 | 419 |
| 14H7 | 417 | 64 | 66 | 69 |

FIG. 12

Sequence alignment of the heavy chain of 13A3.IgG1.3f and variants

```
TIM3.5   QLQLQESGPGLVKPSETLSLTCTVSGGSISSRSYYWGWIRQPPGKGLEWIGSIYYSGFTY
TIM3.11  QLQLQESGPGLVKPSETLSLTCTVSGGSISSRSYYWGWIRQPPGKGLEWIGSIYYSGFTY
TIM3.12  QLQLQESGPGLVKPSETLSLTCTVSGGSISSRSYYWGWIRQPPGKGLEWIGSIYYSGFTY
TIM3.13  QLQLQESGPGLVKPSETLSLTCTVSGGSISSRSYYWGWIRQPPGKGLEWIGSIYYSGFTY
TIM3.10  QLQLQESGPGLVKPSETLSLTCTVSGGSISSRSYYWGWIRQPPGKGLEWIGSIYYSGFTY
TIM3.18  QLQLQESGPGLVKPSETLSLTCTVSGGSISSRSYYWGWIRQPPGKGLEWIGSIYYSGFTY
TIM3.14  QLQLQESGPGLVKPSETLSLTCTVSGGSISSRSYYWGWIRQPPGKGLEWIGSIYYSGFTY
TIM3.16  QLQLQESGPGLVKPSETLSLTCTVSGGSISSRSYYWGWIRQPPGKGLEWIGSIYYSGFTY
TIM3.15  QLQLQESGPGLVKPSETLSLTCTVSGGSISSRSYYWGWIRQPPGKGLEWIGSIYYSGFTY
TIM3.17  QLQLQESGPGLVKPSETLSLTCTVSGGSISSRSYYWGWIRQPPGKGLEWIGSIYYSGFTY
         ************************************************************

TIM3.5   YNPSLKSRVTISVDTSKNQFSLKLSSVTAADTAVYYCATGGPYGDYAHWFDPWGQGTLVT
TIM3.11  YSPSLKSRVTISVDTSKNQFSLKLSSVTAADTAVYYCATGGPYGDYAHWFDPWGQGTLVT
TIM3.12  YAPSLKSRVTISVDTSKNQFSLKLSSVTAADTAVYYCATGGPYGDYAHWFDPWGQGTLVT
TIM3.13  YNPSLKSRVTISVDTSKNQFSLKLSSVTAADTAVYYCATGGPYGDYAHWFEPWGQGTLVT
TIM3.10  YQPSLKSRVTISVDTSKNQFSLKLSSVTAADTAVYYCATGGPYGDYAHWFDPWGQGTLVT
TIM3.18  YQPSLKSRVTISVDTSKNQFSLKLSSVTAADTAVYYCATGGPYGDYAHWFEPWGQGTLVT
TIM3.14  YNPSLKSRVTISVDTSKNQFSLKLSSVTAADTAVYYCATGGPYGDYAHWFDVWGQGTLVT
TIM3.16  YNPSLKSRVTISVDTSKNQFSLKLSSVTAADTAVYYCATGGPYGDYAHWFDLWGQGTLVT
TIM3.15  YNPSLKSRVTISVDTSKNQFSLKLSSVTAADTAVYYCATGGPYGDYAHWFDYWGQGTLVT
TIM3.17  YQPSLKSRVTISVDTSKNQFSLKLSSVTAADTAVYYCATGGPYGDYAHWFDYWGQGTLVT
         *  **********************************************:  *******

TIM3.5   VSSASTKGPSVFPLAPSSKSTSGGTAALGCLVKDYFPEPVTVSWNSGALTSGVHTFPAVL
TIM3.11  VSSASTKGPSVFPLAPSSKSTSGGTAALGCLVKDYFPEPVTVSWNSGALTSGVHTFPAVL
TIM3.12  VSSASTKGPSVFPLAPSSKSTSGGTAALGCLVKDYFPEPVTVSWNSGALTSGVHTFPAVL
TIM3.13  VSSASTKGPSVFPLAPSSKSTSGGTAALGCLVKDYFPEPVTVSWNSGALTSGVHTFPAVL
TIM3.10  VSSASTKGPSVFPLAPSSKSTSGGTAALGCLVKDYFPEPVTVSWNSGALTSGVHTFPAVL
TIM3.18  VSSASTKGPSVFPLAPSSKSTSGGTAALGCLVKDYFPEPVTVSWNSGALTSGVHTFPAVL
TIM3.14  VSSASTKGPSVFPLAPSSKSTSGGTAALGCLVKDYFPEPVTVSWNSGALTSGVHTFPAVL
TIM3.16  VSSASTKGPSVFPLAPSSKSTSGGTAALGCLVKDYFPEPVTVSWNSGALTSGVHTFPAVL
TIM3.15  VSSASTKGPSVFPLAPSSKSTSGGTAALGCLVKDYFPEPVTVSWNSGALTSGVHTFPAVL
TIM3.17  VSSASTKGPSVFPLAPSSKSTSGGTAALGCLVKDYFPEPVTVSWNSGALTSGVHTFPAVL
         ************************************************************

TIM3.5   QSSGLYSLSSVVTVPSSSLGTQTYICNVNHKPSNTKVDKRVEPKSCDKTHTCPPCPAPEA
TIM3.11  QSSGLYSLSSVVTVPSSSLGTQTYICNVNHKPSNTKVDKRVEPKSCDKTHTCPPCPAPEA
TIM3.12  QSSGLYSLSSVVTVPSSSLGTQTYICNVNHKPSNTKVDKRVEPKSCDKTHTCPPCPAPEA
TIM3.13  QSSGLYSLSSVVTVPSSSLGTQTYICNVNHKPSNTKVDKRVEPKSCDKTHTCPPCPAPEA
TIM3.10  QSSGLYSLSSVVTVPSSSLGTQTYICNVNHKPSNTKVDKRVEPKSCDKTHTCPPCPAPEA
TIM3.18  QSSGLYSLSSVVTVPSSSLGTQTYICNVNHKPSNTKVDKRVEPKSCDKTHTCPPCPAPEA
TIM3.14  QSSGLYSLSSVVTVPSSSLGTQTYICNVNHKPSNTKVDKRVEPKSCDKTHTCPPCPAPEA
TIM3.16  QSSGLYSLSSVVTVPSSSLGTQTYICNVNHKPSNTKVDKRVEPKSCDKTHTCPPCPAPEA
TIM3.15  QSSGLYSLSSVVTVPSSSLGTQTYICNVNHKPSNTKVDKRVEPKSCDKTHTCPPCPAPEA
TIM3.17  QSSGLYSLSSVVTVPSSSLGTQTYICNVNHKPSNTKVDKRVEPKSCDKTHTCPPCPAPEA
         ************************************************************

TIM3.5   EGAPSVFLFPPKPKDTLMISRTPEVTCVVVDVSHEDPEVKFNWYVDGVEVHNAKTKPREE
TIM3.11  EGAPSVFLFPPKPKDTLMISRTPEVTCVVVDVSHEDPEVKFNWYVDGVEVHNAKTKPREE
TIM3.12  EGAPSVFLFPPKPKDTLMISRTPEVTCVVVDVSHEDPEVKFNWYVDGVEVHNAKTKPREE
TIM3.13  EGAPSVFLFPPKPKDTLMISRTPEVTCVVVDVSHEDPEVKFNWYVDGVEVHNAKTKPREE
TIM3.10  EGAPSVFLFPPKPKDTLMISRTPEVTCVVVDVSHEDPEVKFNWYVDGVEVHNAKTKPREE
TIM3.18  EGAPSVFLFPPKPKDTLMISRTPEVTCVVVDVSHEDPEVKFNWYVDGVEVHNAKTKPREE
TIM3.14  EGAPSVFLFPPKPKDTLMISRTPEVTCVVVDVSHEDPEVKFNWYVDGVEVHNAKTKPREE
TIM3.16  EGAPSVFLFPPKPKDTLMISRTPEVTCVVVDVSHEDPEVKFNWYVDGVEVHNAKTKPREE
TIM3.15  EGAPSVFLFPPKPKDTLMISRTPEVTCVVVDVSHEDPEVKFNWYVDGVEVHNAKTKPREE
TIM3.17  EGAPSVFLFPPKPKDTLMISRTPEVTCVVVDVSHEDPEVKFNWYVDGVEVHNAKTKPREE
         ************************************************************
```

FIG. 12 (Cont.)

```
TIM3.5     QYNSTYRVVSVLTVLHQDWLNGKEYKCKVSNKALPAPIEKTISKAKGQPREPQVYTLPPS
TIM3.11    QYNSTYRVVSVLTVLHQDWLNGKEYKCKVSNKALPAPIEKTISKAKGQPREPQVYTLPPS
TIM3.12    QYNSTYRVVSVLTVLHQDWLNGKEYKCKVSNKALPAPIEKTISKAKGQPREPQVYTLPPS
TIM3.13    QYNSTYRVVSVLTVLHQDWLNGKEYKCKVSNKALPAPIEKTISKAKGQPREPQVYTLPPS
TIM3.10    QYNSTYRVVSVLTVLHQDWLNGKEYKCKVSNKALPAPIEKTISKAKGQPREPQVYTLPPS
TIM3.18    QYNSTYRVVSVLTVLHQDWLNGKEYKCKVSNKALPAPIEKTISKAKGQPREPQVYTLPPS
TIM3.14    QYNSTYRVVSVLTVLHQDWLNGKEYKCKVSNKALPAPIEKTISKAKGQPREPQVYTLPPS
TIM3.16    QYNSTYRVVSVLTVLHQDWLNGKEYKCKVSNKALPAPIEKTISKAKGQPREPQVYTLPPS
TIM3.15    QYNSTYRVVSVLTVLHQDWLNGKEYKCKVSNKALPAPIEKTISKAKGQPREPQVYTLPPS
TIM3.17    QYNSTYRVVSVLTVLHQDWLNGKEYKCKVSNKALPAPIEKTISKAKGQPREPQVYTLPPS
           ************************************************************

TIM3.5     REEMTKNQVSLTCLVKGFYPSDIAVEWESNGQPENNYKTTPPVLDSDGSFFLYSKLTVDK
TIM3.11    REEMTKNQVSLTCLVKGFYPSDIAVEWESNGQPENNYKTTPPVLDSDGSFFLYSKLTVDK
TIM3.12    REEMTKNQVSLTCLVKGFYPSDIAVEWESNGQPENNYKTTPPVLDSDGSFFLYSKLTVDK
TIM3.13    REEMTKNQVSLTCLVKGFYPSDIAVEWESNGQPENNYKTTPPVLDSDGSFFLYSKLTVDK
TIM3.10    REEMTKNQVSLTCLVKGFYPSDIAVEWESNGQPENNYKTTPPVLDSDGSFFLYSKLTVDK
TIM3.18    REEMTKNQVSLTCLVKGFYPSDIAVEWESNGQPENNYKTTPPVLDSDGSFFLYSKLTVDK
TIM3.14    REEMTKNQVSLTCLVKGFYPSDIAVEWESNGQPENNYKTTPPVLDSDGSFFLYSKLTVDK
TIM3.16    REEMTKNQVSLTCLVKGFYPSDIAVEWESNGQPENNYKTTPPVLDSDGSFFLYSKLTVDK
TIM3.15    REEMTKNQVSLTCLVKGFYPSDIAVEWESNGQPENNYKTTPPVLDSDGSFFLYSKLTVDK
TIM3.17    REEMTKNQVSLTCLVKGFYPSDIAVEWESNGQPENNYKTTPPVLDSDGSFFLYSKLTVDK
           ************************************************************

TIM3.5     SRWQQGNVFSCSVMHEALHNHYTQKSLSLSPGK
TIM3.11    SRWQQGNVFSCSVMHEALHNHYTQKSLSLSPGK
TIM3.12    SRWQQGNVFSCSVMHEALHNHYTQKSLSLSPGK
TIM3.13    SRWQQGNVFSCSVMHEALHNHYTQKSLSLSPGK
TIM3.10    SRWQQGNVFSCSVMHEALHNHYTQKSLSLSPGK
TIM3.18    SRWQQGNVFSCSVMHEALHNHYTQKSLSLSPGK
TIM3.14    SRWQQGNVFSCSVMHEALHNHYTQKSLSLSPGK
TIM3.16    SRWQQGNVFSCSVMHEALHNHYTQKSLSLSPGK
TIM3.15    SRWQQGNVFSCSVMHEALHNHYTQKSLSLSPGK
TIM3.17    SRWQQGNVFSCSVMHEALHNHYTQKSLSLSPGK
           *********************************
```

FIG. 13

Sequence alignment of the heavy chain of 9F6.IgG1.3f and variant (A108T)

```
9F6       QVQLVESGGGLVKPGGSLRLSCAASGFTFSDYYMSWIRQAPGKGLEWVSFISGGGSTIYY
TIM3.7    QVQLVESGGGLVKPGGSLRLSCAASGFTFSDYYMSWIRQAPGKGLEWVSFISGGGSTIYY
          ************************************************************

9F6       ADSVKGRFTISRDNAKNSLFLQMNSLRVEDTAVYYCARDGYSSGWYYYGMDVWGQGTAVT
TIM3.7    ADSVKGRFTISRDNAKNSLFLQMNSLRVEDTAVYYCARDGYSSGWYYYGMDVWGQGTTVT
          *********************************************************:**

9F6       VSSASTKGPSVFPLAPSSKSTSGGTAALGCLVKDYFPEPVTVSWNSGALTSGVHTFPAVL
TIM3.7    VSSASTKGPSVFPLAPSSKSTSGGTAALGCLVKDYFPEPVTVSWNSGALTSGVHTFPAVL
          ************************************************************

9F6       QSSGLYSLSSVVTVPSSSLGTQTYICNVNHKPSNTKVDKRVEPKSCDKTHTCPPCPAPEA
TIM3.7    QSSGLYSLSSVVTVPSSSLGTQTYICNVNHKPSNTKVDKRVEPKSCDKTHTCPPCPAPEA
          ************************************************************

9F6       EGAPSVFLFPPKPKDTLMISRTPEVTCVVVDVSHEDPEVKFNWYVDGVEVHNAKTKPREE
TIM3.7    EGAPSVFLFPPKPKDTLMISRTPEVTCVVVDVSHEDPEVKFNWYVDGVEVHNAKTKPREE
          ************************************************************

9F6       QYNSTYRVVSVLTVLHQDWLNGKEYKCKVSNKALPAPIEKTISKAKGQPREPQVYTLPPS
TIM3.7    QYNSTYRVVSVLTVLHQDWLNGKEYKCKVSNKALPAPIEKTISKAKGQPREPQVYTLPPS
          ************************************************************

9F6       REEMTKNQVSLTCLVKGFYPSDIAVEWESNGQPENNYKTTPPVLDSDGSFFLYSKLTVDK
TIM3.7    REEMTKNQVSLTCLVKGFYPSDIAVEWESNGQPENNYKTTPPVLDSDGSFFLYSKLTVDK
          ************************************************************

9F6       SRWQQGNVFSCSVMHEALHNHYTQKSLSLSPGK
TIM3.7    SRWQQGNVFSCSVMHEALHNHYTQKSLSLSPGK
          ********************************
```

FIG. 14

Sequence alignment of the heavy chain of 8B9.IgG1.3f and variant (S61P)

```
8B9      QVQLQESGPGLVKPSETLSLTCTVSGGSISRHYWNWIRQPPGKGLEWIGYIHYSGSTNYN
TIM3.8   QVQLQESGPGLVKPSETLSLTCTVSGGSISRHYWNWIRQPPGKGLEWIGYIHYSGSTNYN
         ************************************************************

8B9      SSLKSRVTISVDTSKNQFSLKLSSVTAADTAVYYCARDTGYYGMDIWGQGTTVTVSSAST
TIM3.8   PSLKSRVTISVDTSKNQFSLKLSSVTAADTAVYYCARDTGYYGMDIWGQGTTVTVSSAST
         .***********************************************************

8B9      KGPSVFPLAPSSKSTSGGTAALGCLVKDYFPEPVTVSWNSGALTSGVHTFPAVLQSSGLY
TIM3.8   KGPSVFPLAPSSKSTSGGTAALGCLVKDYFPEPVTVSWNSGALTSGVHTFPAVLQSSGLY
         ************************************************************

8B9      SLSSVVTVPSSSLGTQTYICNVNHKPSNTKVDKRVEPKSCDKTHTCPPCPAPEAEGAPSV
TIM3.8   SLSSVVTVPSSSLGTQTYICNVNHKPSNTKVDKRVEPKSCDKTHTCPPCPAPEAEGAPSV
         ************************************************************

8B9      FLFPPKPKDTLMISRTPEVTCVVVDVSHEDPEVKFNWYVDGVEVHNAKTKPREEQYNSTY
TIM3.8   FLFPPKPKDTLMISRTPEVTCVVVDVSHEDPEVKFNWYVDGVEVHNAKTKPREEQYNSTY
         ************************************************************

8B9      RVVSVLTVLHQDWLNGKEYKCKVSNKALPAPIEKTISKAKGQPREPQVYTLPPSREEMTK
TIM3.8   RVVSVLTVLHQDWLNGKEYKCKVSNKALPAPIEKTISKAKGQPREPQVYTLPPSREEMTK
         ************************************************************

8B9      NQVSLTCLVKGFYPSDIAVEWESNGQPENNYKTTPPVLDSDGSFFLYSKLTVDKSRWQQG
TIM3.8   NQVSLTCLVKGFYPSDIAVEWESNGQPENNYKTTPPVLDSDGSFFLYSKLTVDKSRWQQG
         ************************************************************

8B9      NVFSCSVMHEALHNHYTQKSLSLSPGK
TIM3.8   NVFSCSVMHEALHNHYTQKSLSLSPGK
         ***************************
```

FIG. 15

Sequence alignment of the heavy chain of 23B3.IgG1.3f and variant (G6E and D79Y)

```
23B3      QVQLVGSGGGLVKPGGSLRLSCAASGFTFSDYYMSWIRQAPGKGLEWVSFISGSGSIIYY
TIM3.25   QVQLVESGGGLVKPGGSLRLSCAASGFTFSDYYMSWIRQAPGKGLEWVSFISGSGSIIYY
          ***** *******************************************************

23B3      ADSVKGRFTISRDNAKNSLDLQMNSLRAEDTAVYYCARDGMVRGMNFYGMDVWGQGTTVT
TIM3.25   ADSVKGRFTISRDNAKNSLYLQMNSLRAEDTAVYYCARDGMVRGMNFYGMDVWGQGTTVT
          ******************* ****************************************

23B3      VSSASTKGPSVFPLAPSSKSTSGGTAALGCLVKDYFPEPVTVSWNSGALTSGVHTFPAVL
TIM3.25   VSSASTKGPSVFPLAPSSKSTSGGTAALGCLVKDYFPEPVTVSWNSGALTSGVHTFPAVL
          ************************************************************

23B3      QSSGLYSLSSVVTVPSSSLGTQTYICNVNHKPSNTKVDKRVEPKSCDKTHTCPPCPAPEA
TIM3.25   QSSGLYSLSSVVTVPSSSLGTQTYICNVNHKPSNTKVDKRVEPKSCDKTHTCPPCPAPEA
          ************************************************************

23B3      EGAPSVFLFPPKPKDTLMISRTPEVTCVVVDVSHEDPEVKFNWYVDGVEVHNAKTKPREE
TIM3.25   EGAPSVFLFPPKPKDTLMISRTPEVTCVVVDVSHEDPEVKFNWYVDGVEVHNAKTKPREE
          ************************************************************

23B3      QYNSTYRVVSVLTVLHQDWLNGKEYKCKVSNKALPAPIEKTISKAKGQPREPQVYTLPPS
TIM3.25   QYNSTYRVVSVLTVLHQDWLNGKEYKCKVSNKALPAPIEKTISKAKGQPREPQVYTLPPS
          ************************************************************

23B3      REEMTKNQVSLTCLVKGFYPSDIAVEWESNGQPENNYKTTPPVLDSDGSFFLYSKLTVDK
TIM3.25   REEMTKNQVSLTCLVKGFYPSDIAVEWESNGQPENNYKTTPPVLDSDGSFFLYSKLTVDK
          ************************************************************

23B3      SRWQQGNVFSCSVMHEALHNHYTQKSLSLSPGK
TIM3.25   SRWQQGNVFSCSVMHEALHNHYTQKSLSLSPGK
          *********************************
```

FIG. 16

| H.n.* | Rec. Ab name | Heavy chain | | | | | | Light chain | | | | | | |
|---|---|---|---|---|---|---|---|---|---|---|---|---|---|---|
| | | | VH | | | | | LC | VL | | | | | LC isotype |
| | | HC | VH | CDR1 | CDR2 | CDR3 | HC isotype | | VL | VL | CDR1 | CDR2 | CDR3 | |
| 13A3 | - | 301, 302 | 34 | 41 | 46 | 53 | hIgG4 | 29 | VK1 | 60 | 64 | 66 | 68 | hKappa |
| | TIM3.5-IgG1.1f | 1, 8* | | | | | IgG1.1f | | | | | | | |
| | 13A3-IgG1.1f | | | | | | | | | | | | | |
| | 13A3-IgG1.3f | 15, 22 | | | | | IgG1.3f | | | | | | | |
| | 13A3-IgG4P | 303, 304 | | | | | IgG4 | | | | | | | |
| | TIM3.10-IgG1.1f (13A3 VH-N60Q) | 72, 82 | 112 | | 122 | | IgG1.1f | | | | | | | |
| | TIM3.10-IgG1.3f | 92, 102 | | | | | IgG1.3f | | | | | | | |
| | TIM3.10-IgG4P | 305, 306 | | | | | IgG4P | | | | | | | |
| | TIM3.11-IgG1.1f (13A3 VH-N60S) | 73, 83 | 113 | | 123 | | IgG1.1f | | | | | | | |
| | TIM3.11-IgG1.3f | 93, 103 | | | | | IgG1.3f | | | | | | | |
| | TIM3.11-IgG4P | 307, 308 | | | | | IgG4P | | | | | | | |
| | TIM3.12-IgG1.1f (13A3 VH-N60A) | 74, 84 | 114 | | 124 | | IgG1.1f | | | | | | | |
| | TIM3.12-IgG1.3f | 94, 104 | | | | | IgG1.3f | | | | | | | |
| | TIM3.12-IgG4P | 309, 310 | | | | | IgG4P | | | | | | | |
| | TIM3.13-IgG1.1f (13A3 VH-D101E) | 75, 85 | 115 | | 46 | 126 | IgG1.1f | | | | | | | |
| | TIM3.13-IgG1.3f | 95, 105 | | | | | IgG1.3f | | | | | | | |
| | TIM3.13-IgG4P | 311, 312 | | | | | IgG4P | | | | | | | |
| | TIM3.14-IgG1.1 (13A3 VH-P102V) | 76, 86 | 116 | | | 127 | IgG1.1f | | | | | | | |
| | TIM3.14-IgG1.3f | 96, 106 | | | | | IgG1.3f | | | | | | | |
| | TIM3.14-IgG4P | 313, 314 | | | | | IgG4P | | | | | | | |
| | TIM3.15-IgG1.1f (13A3 VH-P102Y) | 77, 87 | 117 | | | 128 | IgG1.1f | | | | | | | |
| | TIM3.15-IgG1.3f | 97, 107 | | | | | IgG1.3f | | | | | | | |
| | TIM3.15-IgG4P | 315, 316 | | | | | IgG4P | | | | | | | |

FIG. 16 (Cont.)

| H.n.* | Rec. Ab name | Heavy chain | | | | | | Light chain | | | | | | |
|---|---|---|---|---|---|---|---|---|---|---|---|---|---|---|
| | | HC | VH | CDR1 | CDR2 | CDR3 | HC isotype | LC | VL | VL | CDR1 | CDR2 | CDR3 | LC isotype |
| | TIM3.16-IgG1.1f (13A3 VH-P102L) | 78, 88 | 118 | | | 129 | IgG1.1f | | | | | | | |
| | TIM3.16-IgG1.3f | 98, 108 | | | | | IgG1.3f | | | | | | | |
| | TIM3.16-IgG4P | 317, 318 | | | | | IgG4P | | | | | | | |
| | TIM3.17-IgG1.1f (13A3 VH-N60Q,P102Y) | 79, 89 | 119 | | 122 | 128 | IgG1.1f | | | | | | | |
| | TIM3.17-IgG1.3f | 99, 109 | | | | | IgG1.3f | | | | | | | |
| | TIM3.17-IgG4P | 319, 320 | | | | | IgG4P | | | | | | | |
| | TIM3.18-IgG1.1f (13A3-VH-N60Q, D101E) | 349, 350 | 364 | | | 126 | IgG1.1f | | | | | | | |
| | TIM3.18-IgG1.3f (13A3-VH-N60Q, D101E) | 351, 352 | | | | | IgG1.3f | | | | | | | |
| | TIM3.18-IgG4P (13A3-VH-N60Q, D101E) | 353, 354 | | | | | IgG4P | | | | | | | |
| 8B9 | - | 321, 322 | 35 | 42 | 47 | 54 | IgG1za | 30 | VK1 | 61 | | | 69 | |
| | 8B9-IgG1.1f | 2, 9 | | | | | IgG1.1f | | | | | | | |
| | 8B9-IgG1.3f | 16, 23 | | | | | IgG1.3f | | | | | | | |
| | 8B9-IgG4P | 323, 324 | | | | | IgG4P | | | | | | | |
| | TIM3.8-IgG1.1f (8B9 VH S61P) | 80, 90 | 120 | | 125 | | IgG1.1f | | | | | | | |
| | TIM3.8-IgG1.3f | 100, 110 | | | | | IgG1.3f | | | | | | | |
| | TIM3.8-IgG4P | 325, 326 | | | | | IgG4P | | | | | | | |
| 8C4 | - | 327, 328 | 36 | 43 | 48 | 55 | IgG1za | | | | | | | |
| | TIM3.6-IgG1.1f (8C4) | 3, 10 | | | | | IgG1.1f | | | | | | | |
| | TIM3.6-IgG1.3f | 17, 24 | | | | | IgG1.3f | | | | | | | |
| | TIM3.6-IgG4P | 329, 330 | | | | | IgG4P | | | | | | | |
| 17C3 | - | 331, 332 | 37 | 44 | 49 | 56 | IgG1za | 29 | VK1 | 60 | | | 68 | |

FIG. 16 (Cont.)

| H.n.* | Rec. Ab name | Heavy chain | | | | | | Light chain | | | | | | | LC isotype |
|---|---|---|---|---|---|---|---|---|---|---|---|---|---|---|
| | | | VH | | | | HC isotype | | VL | | | | | |
| | | HC | VH | CDR1 | CDR2 | CDR3 | | LC | VL | VL | CDR1 | CDR2 | CDR3 | |
| | TIM3.2-IgG1.1f (17C3-IgG1.1f) | 4,11 | | | | | IgG1.1f | | | | | | | |
| | TIM3.2-IgG1.3f | 18,25 | | | | | IgG1.3f | | | | | | | |
| | TIM3.2-IgG4P | 333,334 | | | | | IgG4P | | | | | | | |
| 9F6 | - | 335,336 | 38 | 45 | 50 | 57 | IgG1za | 32 | VK1 | 62 | 65 | 67 | 70 | |
| | | | | | | | | 33 | VK2 | 63 | 64 | 66 | 71 | |
| | | | | | | | | 31 | VK3 | 61 | | | 69 | |
| | | | | | | | | 33 | VK2 | 63 | | | 71 | |
| - | 9F6-IgG1.1f | 5,12 | | | | | IgG1.1f | | | | | | | |
| | 9F6-IgG1.3f | 19,26 | | | | | IgG1.3f | | | | | | | |
| | 9F6-IgG4P | 337,338 | | | | | IgG4P | | | | | | | |
| | TIM3.7-IgG1.1f (9F6 VK2 VH-A108T) | 81,91 | 121 | | | | IgG1.1f | | | | | | | |
| | TIM3.7-IgG1.3f | 101,111 | | | | | IgG1.3f | | | | | | | |
| | TIM3.7-IgG4P | 339,340 | | | | | IgG4P | | | | | | | |
| 3G4 | - | 341,342 | 39 | | 51 | 58 | IgG1za | 29 | VK1 | 60 | | | 68 | |
| - | TIM3.4-IgG1.1f 3G4-IgG1.1f | 6,13 | | | | | IgG1.1f | | | | | | | |
| | TIM3.4-IgG1.3f | 20,27 | | | | | IgG1.3f | | | | | | | |
| | TIM3.4-IgG4P | 343,344 | | | | | IgG4P | | | | | | | |
| 17C8 | - | 345,346 | 40 | | 52 | 59 | IgG4 | 30 | VK1 | 61 | | | 69 | |
| - | TIM3.9-IgG1.1f (17C8) | 7,14 | | | | | IgG1.1f | | | | | | | |
| | TIM3.9-IgG1.3f | 21,28 | | | | | IgG1.3f | | | | | | | |
| | TIM3.9-IgG4P | 347,348 | | | | | IgG4P | | | | | | | |
| 14H7 | - | 386,387 | 410 | | 413 | 414 | hIgG4 | 408 | VK1 | 417 | | | | |
| | 14H7-IgG1.1f | 388,389 | | | | | IgG1.1f | | | | | | 69 | |
| | TIM3.24-IgG1.1f | | | | | | | | | | | | | |
| | 14H7-IgG1.3f | 390,391 | | | | | IgG1.3f | | | | | | | |
| | TIM3.24-IgG1.3f | | | | | | | | | | | | | |

FIG. 16 (Cont.)

| H.n.* | Rec. Ab name | Heavy chain ||||| Light chain ||||||| 
| | | HC | VH | VH CDR1 | VH CDR2 | VH CDR3 | HC isotype | LC | VL | VL | VL CDR1 | VL CDR2 | VL CDR3 | LC isotype |
|---|---|---|---|---|---|---|---|---|---|---|---|---|---|---|
| | 14H7-IgG4P | 392, 393 | | | | | IgG4P | | | | | | | |
| | TIM3.24-IgG4P | | | | | | | | | | | | | |
| 23B3 | - | 394, 395 | 411 | | 415 | 416 | hIgG4 | 29 | VK1 | 60 | | | 68 | |
| | | | | | | | | 409 | VK2 | 418 | | | 419 | |
| | 23B3-IgG1.1f | 396, 397 | | | | | IgG1.1f | 29 | VK1 | 60 | | | 68 | |
| | 23B3-IgG1.3f | 398, 399 | | | | | IgG1.3f | | | | | | | |
| | 23B3-IgG4P | 400, 401 | | | | | IgG4P | | | | | | | |
| | TIM3.25-IgG1.1f | 402, 403 | 412 | | | | IgG1.1f | | | | | | | |
| | TIM3.25-IgG1.3f | 404, 405 | | | | | IgG1.3f | | | | | | | |
| | TIM3.25-IgG4P | 406, 407 | | | | | IgG4P | | | | | | | |

Ab treatment

Binding of 13A3-biotin to CHO-hTIM3 pre-incubated with anti-TIM3 hybridoma

FIG. 25

Epitope residues on TIM3 protein

```
              10         20         30         40         50         60
TIM3   MFSHLPFDCV LLLLLLLLTR SSEVEYRAEV GQNAYLPCFY TPAAPGNLVP VCWGKGACPV
13A3                                                                CP
3G4                                                                 CPV
17C3                                                                CPV
8B9                                           L 70         80         90        100        110        120
TIM3   FECGNVVLRT DERDVNYWTS RYWLNGDFRK GDVSLTIENV TLADSGIYCC RIQIPGIMND
13A3   FEC                                          D                 D
3G4    FEC                                          D          R Q  G M
17C3   FECG                                         D                 G
8B9               W S       R  WL GD R             D 130        140        150        160        170        180
TIM3   EKFNLKLVIK PAKVTPAPTR QRDFTAAFPR MLTTRGHGPA ETQTLGSLPD INLTQISTLA 190        200        210        220        230        240
TIM3   NELRDSRLAN DLRDSGATIR IGIYIGAGIC AGLALALIFG ALIFKWYSHS KEKIQNLSLI 250        260        270        280        290        300
TIM3   SLANLPPSGL ANAVAEGIRS EENIYTIEEN VYEVEEPNEY YCYVSSRQQP SQPLGCRFAMP
```

Octet HTX, 25C, PBS pH 7.4 with 1mg/mL BSA, hTIM3-ECD-mFc captured, anti-TIM3 Ab panel bound, binding of extruded PS tested at ½ dilution.

FIG. 27

Summary of Functional Activity of Anti-TIM3 Antibodies

| Clone | Binding Assay (EC50 nM) | | | | T Cell Assay | TIL Assay | PS-TIM3 Blocking |
|---|---|---|---|---|---|---|---|
| | Human T cells (nM) | Cyno T cells (nM) | CHO-huTIM (nM) | CHO-cynoTIM3 (nM) | | | |
| 13A3 (IgG4) | 0.27 | 0.4 | 0.4 | 0.47 | N/A | Dose dep | Yes |
| 3G4 (IgG2) | 0.3 | Non-C | 0.67 | 1.3 | Dose dep | Dose dep | Yes |
| 17C3 (IgG1) | 0.24 | Non-C | 0.47 | 1.4 | Dose dep | Dose dep | Yes |
| 17C8 (IgG1) | 0.13 | Non-C | 0.33 | Non-C | Dose dep | Dose Dep | Yes |
| 9F6 (IgG1) | 0.13 | Non-C | 0.47 | Non-C | Weak | No activity | Yes |
| 8B9 (IgG4) | 0.13 | Non-C | 0.2 | Non-C | Weak | No activity | Yes |
| 8C4 (IgG1) | 0.73 | Non-C | N/A | Non-C | Weak | No activity | Yes |

FIG. 28

Description of Sequences Represented by the SEQ ID NOs

| SEQ ID NO. | Antibody | Description | AA/NT |
|---|---|---|---|
| 1 | 13A3 | IgG1.1f HC | Amino Acid |
| 2 | 8B9 | IgG1.1f HC | Amino Acid |
| 3 | 8C4 | IgG1.1f HC | Amino Acid |
| 4 | 17C3 | IgG1.1f HC | Amino Acid |
| 5 | 9F6 | IgG1.1f HC | Amino Acid |
| 6 | 3G4 | IgG1.1f HC | Amino Acid |
| 7 | 17C8 | IgG1.1f HC | Amino Acid |
| 8 | 13A3 | IgG1.1f HC (no C-terminal K) | Amino Acid |
| 9 | 8B9 | IgG1.1f HC (no C-terminal K) | Amino Acid |
| 10 | 8C4 | IgG1.1f HC (no C-terminal K) | Amino Acid |
| 11 | 17C3 | IgG1.1f HC (no C-terminal K) | Amino Acid |
| 12 | 9F6 | IgG1.1f HC (no C-terminal K) | Amino Acid |
| 13 | 3G4 | IgG1.1f HC (no C-terminal K) | Amino Acid |
| 14 | 17C8 | IgG1.1f HC (no C-terminal K) | Amino Acid |
| 15 | 13A3 | IgG1.3f HC | Amino Acid |
| 16 | 8B9 | IgG1.3f HC | Amino Acid |
| 17 | 8C4 | IgG1.3f HC | Amino Acid |
| 18 | 17C3 | IgG1.3f HC | Amino Acid |
| 19 | 9F6 | IgG1.3f HC | Amino Acid |
| 20 | 3G4 | IgG1.3f HC | Amino Acid |
| 21 | 17C8 | IgG1.3f HC | Amino Acid |
| 22 | 13A3 | IgG1.3f HC (no C-terminal K) | Amino Acid |
| 23 | 8B9 | IgG1.3f HC (no C-terminal K) | Amino Acid |
| 24 | 8C4 | IgG1.3f HC (no C-terminal K) | Amino Acid |
| 25 | 17C3 | IgG1.3f HC (no C-terminal K) | Amino Acid |
| 26 | 9F6 | IgG1.3f HC (no C-terminal K) | Amino Acid |
| 27 | 3G4 | IgG1.3f HC (no C-terminal K) | Amino Acid |
| 28 | 17C8 | IgG1.3f HC (no C-terminal K) | Amino Acid |
| 29 | 13A3, 17C3, 3G4, 23B3 and TIM3.25 (23B3-VH-G6E-D79Y) | LC | Amino Acid |
| 30 | 8B9, 8C4, 17C8 | LC | Amino Acid |
| 31 | 9F6 (VK3) | LC | Amino Acid |
| 32 | 9F6 (VK1) | LC | Amino Acid |
| 33 | 9F6 (VK2) | LC | Amino Acid |
| 34 | 13A3 | VH | Amino Acid |
| 35 | 8B9 | VH | Amino Acid |
| 36 | 8C4 | VH | Amino Acid |

FIG. 28 (Cont).

| SEQ ID NO. | Antibody | Description | AA/NT |
|---|---|---|---|
| 37 | 17C3 | VH | Amino Acid |
| 38 | 9F6 | VH | Amino Acid |
| 39 | 3G4 | VH | Amino Acid |
| 40 | 17C8 | VH | Amino Acid |
| 41 | 13A3, including the following 13A3 variants: N60Q; N60S; N60A; D101E; P102V; P102Y; P102L; N60Q and P102Y; N60Q and D101E | CDR1 (VH) | Amino Acid |
| 42 | 8B9, including the 8B9 (S61P) variant | CDR1 (VH) | Amino Acid |
| 43 | 8C4 | CDR1 (VH) | Amino Acid |
| 44 | 17C3 | CDR1 (VH) | Amino Acid |
| 45 | 9F6, including the 9F6 (A108T) variant; 3G4; 17C8; 14H7 and TIM3.24; 23B3 and TIM3.25 (23B3-VH-G6E-D79Y) | CDR1 (VH) | Amino Acid |
| 46 | 13A3, including the following 13A3 variants: D101E, P102V, P102Y, and P102L | CDR2 (VH) | Amino Acid |
| 47 | 8B9 | CDR2 (VH) | Amino Acid |
| 48 | 8C4 | CDR2 (VH) | Amino Acid |
| 49 | 17C3 | CDR2 (VH) | Amino Acid |
| 50 | 9F6, including the 9F6 (A108T) variant | CDR2 (VH) | Amino Acid |
| 51 | 3G4 | CDR2 (VH) | Amino Acid |
| 52 | 17C8 | CDR2 (VH) | Amino Acid |
| 53 | 13A3, including the following 13A3 variants: N60Q, N60S, N60A | CDR3 (VH) | Amino Acid |
| 54 | 8B9, including the 8B9 (S61P) variant | CDR3 (VH) | Amino Acid |
| 55 | 8C4 | CDR3 (VH) | Amino Acid |
| 56 | 17C3 | CDR3 (VH) | Amino Acid |
| 57 | 9F6, including the 9F6 (A108T) variant | CDR3 (VH) | Amino Acid |
| 58 | 3G4 | CDR3 (VH) | Amino Acid |

FIG. 28 (Cont).

| SEQ ID NO. | Antibody | Description | AA/NT |
|---|---|---|---|
| 59 | 17C8 | CDR3 (VH) | Amino Acid |
| 60 | 13A3, 17C3, 3G4; 23B3 (VK1)and TIM3.25 (23B3-VH-G6E-D79Y) | VL | Amino Acid |
| 61 | 8B9, 8C4, 17C8 , 9F6 (VK3) | VL | Amino Acid |
| 62 | 9F6 (VK1) | VL | Amino Acid |
| 63 | 9F6 (VK2) | VL | Amino Acid |
| 64 | 13A3, 8B9, 8C4, 17C3, 9F6 (VK2, VK3), 3G4, 17C8; 14H7; TIM3.24; 23B3 (VK1 and VK2); TIM3.25 | CDR1 (VL) | Amino Acid |
| 65 | 9F6 (VK1) | CDR1 (VL) | Amino Acid |
| 66 | 13A3, 8B9, 8C4, 17C3, 9F6 (VK2, VK3), 3G4, 17C8; 14H7; TIM3.24; 23B3 (VK1 and VK2); TIM3.25 | CDR2 (VL) | Amino Acid |
| 67 | 9F6 (VK1) | CDR2 (VL) | Amino Acid |
| 68 | 13A3, 17C3, 3G4; 23B3 (VK1); TIM3.25 | CDR3 (VL) | Amino Acid |
| 69 | 8B9, 8C4, 9F6 (VK3), 17C8; 14H7; TIM3.24 | CDR3 (VL) | Amino Acid |
| 70 | 9F6 (VK1) | CDR3 (VL) | Amino Acid |
| 71 | 9F6 (VK2) | CDR3 (VL) | Amino Acid |
| 72 | 13A3 (N60Q) | IgG1.1f HC | Amino Acid |
| 73 | 13A3 (N60S) | IgG1.1f HC | Amino Acid |
| 74 | 13A3 (N60A) | IgG1.1f HC | Amino Acid |
| 75 | 13A3 (D101E) | IgG1.1f HC | Amino Acid |
| 76 | 13A3 (P102V) | IgG1.1f HC | Amino Acid |
| 77 | 13A3 (P102Y) | IgG1.1f HC | Amino Acid |
| 78 | 13A3 (P102L) | IgG1.1f HC | Amino Acid |
| 79 | 13A3 (N60Q, P102Y) | IgG1.1f HC | Amino Acid |
| 349 | 13A3 (N60Q, D101E) | IgG1.1f HC | Amino Acid |
| 80 | 8B9 (S61P) | IgG1.1f HC | Amino Acid |
| 81 | 9F6 (A108T) | IgG1.1f HC | Amino Acid |
| 82 | 13A3 (N60Q) | IgG1.1f HC (no C-terminal K) | Amino Acid |
| 83 | 13A3 (N60S) | IgG1.1f HC (no C-terminal K) | Amino Acid |

FIG. 28 (Cont).

| SEQ ID NO. | Antibody | Description | AA/NT |
|---|---|---|---|
| 84 | 13A3 (N60A) | IgG1.1f HC (no C-terminal K) | Amino Acid |
| 85 | 13A3 (D101E) | IgG1.1f HC (no C-terminal K) | Amino Acid |
| 86 | 13A3 (P102V) | IgG1.1f HC (no C-terminal K) | Amino Acid |
| 87 | 13A3 (P102Y) | IgG1.1f HC (no C-terminal K) | Amino Acid |
| 88 | 13A3 (P102L) | IgG1.1f HC (no C-terminal K) | Amino Acid |
| 89 | 13A3 (N60Q, P102Y) | IgG1.1f HC (no C-terminal K) | Amino Acid |
| 350 | 13A3 (N60Q, D101E) | IgG1.1f HC (no C-terminal K) | Amino Acid |
| 90 | 8B9 (S61P) | IgG1.1f HC (no C-terminal K) | Amino Acid |
| 91 | 9F6 (A108T) | IgG1.1f HC (no C-terminal K) | Amino Acid |
| 92 | 13A3 (N60Q) | IgG1.3f HC | Amino Acid |
| 93 | 13A3 (N60S) | IgG1.3f HC | Amino Acid |
| 94 | 13A3 (N60A) | IgG1.3f HC | Amino Acid |
| 95 | 13A3 (D101E) | IgG1.3f HC | Amino Acid |
| 96 | 13A3 (P102V) | IgG1.3f HC | Amino Acid |
| 97 | 13A3 (P102Y) | IgG1.3f HC | Amino Acid |
| 98 | 13A3 (P102L) | IgG1.3f HC | Amino Acid |
| 99 | 13A3 (N60Q, P102Y) | IgG1.3f HC | Amino Acid |
| 351 | 13A3 (N60Q, D101E) | IgG1.3f HC | Amino Acid |
| 100 | 8B9 (S61P) | IgG1.3f HC | Amino Acid |
| 101 | 9F6 (A108T) | IgG1.3f HC | Amino Acid |
| 102 | 13A3 (N60Q) | IgG1.3f HC (no C-terminal K) | Amino Acid |
| 103 | 13A3 (N60S) | IgG1.3f HC (no C-terminal K) | Amino Acid |
| 104 | 13A3 (N60A) | IgG1.3f HC (no C-terminal K) | Amino Acid |
| 105 | 13A3 (D101E) | IgG1.3f HC (no C-terminal K) | Amino Acid |
| 106 | 13A3 (P102V) | IgG1.3f HC (no C-terminal K) | Amino Acid |
| 107 | 13A3 (P102Y) | IgG1.3f HC (no C-terminal K) | Amino Acid |
| 108 | 13A3 (P102L) | IgG1.3f HC (no C-terminal K) | Amino Acid |
| 109 | 13A3 (N60Q, P102Y) | IgG1.3f HC (no C-terminal K) | Amino Acid |
| 352 | 13A3 (N60Q, D101E) | IgG1.3f HC (no C-terminal K) | Amino Acid |
| 110 | 8B9 (S61P) | IgG1.3f HC (no C-terminal K) | Amino Acid |
| 111 | 9F6 (A108T) | IgG1.3f HC (no C-terminal K) | Amino Acid |
| 112 | 13A3 (N60Q) | VH | Amino Acid |
| 113 | 13A3 (N60S) | VH | Amino Acid |
| 114 | 13A3 (N60A) | VH | Amino Acid |
| 115 | 13A3 (D101E) | VH | Amino Acid |
| 116 | 13A3 (P102V) | VH | Amino Acid |
| 117 | 13A3 (P102Y) | VH | Amino Acid |

FIG. 28 (Cont).

| SEQ ID NO. | Antibody | Description | AA/NT |
|---|---|---|---|
| 118 | 13A3 (P102L) | VH | Amino Acid |
| 119 | 13A3 (N60Q, P102Y) | VH | Amino Acid |
| 364 | 13A3 (N60Q, D101E) | VH | Amino Acid |
| 120 | 8B9 (S61P) | VH | Amino Acid |
| 121 | 9F6 (A108T) | VH | Amino Acid |
| 122 | 13A3 (N60Q); 13A3 (N60Q, P102Y); 13A3 (N60Q, D101E) | CDR2 (VH) | Amino Acid |
| 123 | 13A3 (N60S) | CDR2 (VH) | Amino Acid |
| 124 | 13A3 (N60A) | CDR2 (VH) | Amino Acid |
| 125 | 8B9 (S61P) | CDR2 (VH) | Amino Acid |
| 126 | 13A3 (D101E); 13A3 (N60Q, D101E) | CDR3 (VH) | Amino Acid |
| 127 | 13A3 (P102V) | CDR3 (VH) | Amino Acid |
| 128 | 13A3 (P102Y); 13A3 (N60Q, P102Y) | CDR3 (VH) | Amino Acid |
| 129 | 13A3 (P102L) | CDR3 (VH) | Amino Acid |
| 130 | All antibodies | HC Constant Domain (IgG1.1f) | Amino Acid |
| 131 | All antibodies | HC Constant Domain (IgG1.1f) (no C-terminal K) | Amino Acid |
| 132 | All antibodies | HC Constant Domain (IgG1.3f) | Amino Acid |
| 133 | All antibodies | HC Constant Domain (IgG1.3f) (no C-terminal K) | Amino Acid |
| 134 | 13A3 | IgG1.1f HC | Nucleotide |
| 135 | 8B9 | IgG1.1f HC | Nucleotide |
| 136 | 8C4 | IgG1.1f HC | Nucleotide |
| 137 | 17C3 | IgG1.1f HC | Nucleotide |
| 138 | 9F6 | IgG1.1f HC | Nucleotide |
| 139 | 3G4 | IgG1.1f HC | Nucleotide |
| 140 | 17C8 | IgG1.1f HC | Nucleotide |
| 141 | 13A3 | IgG1.1f HC (no C-terminal K) | Nucleotide |
| 142 | 8B9 | IgG1.1f HC (no C-terminal K) | Nucleotide |
| 143 | 8C4 | IgG1.1f HC (no C-terminal K) | Nucleotide |
| 144 | 17C3 | IgG1.1f HC (no C-terminal K) | Nucleotide |
| 145 | 9F6 | IgG1.1f HC (no C-terminal K) | Nucleotide |
| 146 | 3G4 | IgG1.1f HC (no C-terminal K) | Nucleotide |
| 147 | 17C8 | IgG1.1f HC (no C-terminal K) | Nucleotide |
| 148 | 13A3 | IgG1.3f HC | Nucleotide |
| 149 | 8B9 | IgG1.3f HC | Nucleotide |
| 150 | 8C4 | IgG1.3f HC | Nucleotide |

FIG. 28 (Cont).

| SEQ ID NO. | Antibody | Description | AA/NT |
|---|---|---|---|
| 151 | 17C3 | IgG1.3f HC | Nucleotide |
| 152 | 9F6 | IgG1.3f HC | Nucleotide |
| 153 | 3G4 | IgG1.3f HC | Nucleotide |
| 154 | 17C8 | IgG1.3f HC | Nucleotide |
| 155 | 13A3 | IgG1.3f HC (no C-terminal K) | Nucleotide |
| 156 | 8B9 | IgG1.3f HC (no C-terminal K) | Nucleotide |
| 157 | 8C4 | IgG1.3f HC (no C-terminal K) | Nucleotide |
| 158 | 17C3 | IgG1.3f HC (no C-terminal K) | Nucleotide |
| 159 | 9F6 | IgG1.3f HC (no C-terminal K) | Nucleotide |
| 160 | 3G4 | IgG1.3f HC (no C-terminal K) | Nucleotide |
| 161 | 17C8 | IgG1.3f HC (no C-terminal K) | Nucleotide |
| 162 | 13A3, 17C3, 3G4; TIM3.25 | LC | Nucleotide |
| 163 | 8B9, 8C4, 17C8 | LC | Nucleotide |
| 164 | 9F6 (VK3) | LC | Nucleotide |
| 165 | 9F6 (VK1) | LC | Nucleotide |
| 166 | 9F6 (VK2) | LC | Nucleotide |
| 167 | 13A3 | VH | Nucleotide |
| 168 | 8B9 | VH | Nucleotide |
| 169 | 8C4 | VH | Nucleotide |
| 170 | 17C3 | VH | Nucleotide |
| 171 | 9F6 | VH | Nucleotide |
| 172 | 3G4 | VH | Nucleotide |
| 173 | 17C8 | VH | Nucleotide |
| 174 | 13A3, including the following 13A3 variants: N60Q; N60S; N60A; D101E; P102V; P102Y; P102L; N60Q and P102Y; 13A3 (N60Q, D101E) | CDR1 (VH) | Nucleotide |
| 175 | 8B9, including the 8B9 (S61P) variant | CDR1 (VH) | Nucleotide |
| 176 | 8C4 | CDR1 (VH) | Nucleotide |
| 177 | 17C3 | CDR1 (VH) | Nucleotide |
| 178 | 9F6, including the 9F6 (A108T) variant; 3G4; 17C8; 14H7; TIM3.24; 23B3; TIM3.25 | CDR1 (VH) | Nucleotide |

FIG. 28 (Cont).

| SEQ ID NO. | Antibody | Description | AA/NT |
|---|---|---|---|
| 179 | 13A3, including the following 13A3 variants: D101E, P102V, P102Y, and P102L | CDR2 (VH) | Nucleotide |
| 180 | 8B9 | CDR2 (VH) | Nucleotide |
| 181 | 8C4 | CDR2 (VH) | Nucleotide |
| 182 | 17C3 | CDR2 (VH) | Nucleotide |
| 183 | 9F6, including the 9F6 (A108T) variant | CDR2 (VH) | Nucleotide |
| 184 | 3G4 | CDR2 (VH) | Nucleotide |
| 185 | 17C8 | CDR2 (VH) | Nucleotide |
| 186 | 13A3, including the following 13A3 variants: N60Q, N60S, N60A | CDR3 (VH) | Nucleotide |
| 187 | 8B9, including the 8B9 (S61P) variant | CDR3 (VH) | Nucleotide |
| 188 | 8C4 | CDR3 (VH) | Nucleotide |
| 189 | 17C3 | CDR3 (VH) | Nucleotide |
| 190 | 9F6, including the 9F6 (A108T) variant | CDR3 (VH) | Nucleotide |
| 191 | 3G4 | CDR3 (VH) | Nucleotide |
| 192 | 17C8 | CDR3 (VH) | Nucleotide |
| 193 | 13A3, 17C3, 3G4; 23B3 (VK1); TIM3.25 | VL | Nucleotide |
| 194 | 8B9, 8C4, 17C8, 9F6 (VK3) | VL | Nucleotide |
| 195 | 9F6 (VK1) | VL | Nucleotide |
| 196 | 9F6 (VK2) | VL | Nucleotide |
| 197 | 13A3, 8B9, 8C4, 17C3, 9F6 (VK2, VK3), 3G4, 17C8; 14H7; TIM3.24; 23B3 (VK1 and VK2); TIM3.25 | CDR1 (VL) | Nucleotide |
| 198 | 9F6 (VK1) | CDR1 (VL) | Nucleotide |
| 199 | 13A3, 8B9, 8C4, 17C3, 9F6 (VK2, VK3), 3G4, 17C8; 14H7; TIM3.24; 23B3 (VK1 and VK2); TIM3.25 | CDR2 (VL) | Nucleotide |
| 200 | 9F6 (VK1) | CDR2 (VL) | Nucleotide |
| 201 | 13A3, 17C3, 3G4; 23B3 (VK1); TIM3.25 | CDR3 (VL) | Nucleotide |

FIG. 28 (Cont).

| SEQ ID NO. | Antibody | Description | AA/NT |
|---|---|---|---|
| 202 | 8B9, 8C4, 9F6 (VK3), 17C8; 14H7; TIM3.24 | CDR3 (VL) | Nucleotide |
| 203 | 9F6 (VK1) | CDR3 (VL) | Nucleotide |
| 204 | 9F6 (VK2) | CDR3 (VL) | Nucleotide |
| 205 | 13A3 (N60Q) | IgG1.1f HC | Nucleotide |
| 206 | 13A3 (N60S) | IgG1.1f HC | Nucleotide |
| 207 | 13A3 (N60A) | IgG1.1f HC | Nucleotide |
| 208 | 13A3 (D101E) | IgG1.1f HC | Nucleotide |
| 209 | 13A3 (P102V) | IgG1.1f HC | Nucleotide |
| 210 | 13A3 (P102Y) | IgG1.1f HC | Nucleotide |
| 211 | 13A3 (P102L) | IgG1.1f HC | Nucleotide |
| 212 | 13A3 (N60Q, P102Y) | IgG1.1f HC | Nucleotide |
| 355 | 13A3 (N60Q, D101E) | IgG1.1f HC | Nucleotide |
| 213 | 8B9 (S61P) | IgG1.1f HC | Nucleotide |
| 214 | 9F6 (A108T) | IgG1.1f HC | Nucleotide |
| 215 | 13A3 (N60Q) | IgG1.1f HC (no C-terminal K) | Nucleotide |
| 216 | 13A3 (N60S) | IgG1.1f HC (no C-terminal K) | Nucleotide |
| 217 | 13A3 (N60A) | IgG1.1f HC (no C-terminal K) | Nucleotide |
| 218 | 13A3 (D101E) | IgG1.1f HC (no C-terminal K) | Nucleotide |
| 219 | 13A3 (P102V) | IgG1.1f HC (no C-terminal K) | Nucleotide |
| 220 | 13A3 (P102Y) | IgG1.1f HC (no C-terminal K) | Nucleotide |
| 221 | 13A3 (P102L) | IgG1.1f HC (no C-terminal K) | Nucleotide |
| 222 | 13A3 (N60Q, P102Y) | IgG1.1f HC (no C-terminal K) | Nucleotide |
| 356 | 13A3 (N60Q, D101E) | IgG1.1f HC (no C-terminal K) | Nucleotide |
| 223 | 8B9 (S61P) | IgG1.1f HC (no C-terminal K) | Nucleotide |
| 224 | 9F6 (A108T) | IgG1.1f HC (no C-terminal K) | Nucleotide |
| 225 | 13A3 (N60Q) | IgG1.3f HC | Nucleotide |
| 226 | 13A3 (N60S) | IgG1.3f HC | Nucleotide |
| 227 | 13A3 (N60A) | IgG1.3f HC | Nucleotide |
| 228 | 13A3 (D101E) | IgG1.3f HC | Nucleotide |
| 229 | 13A3 (P102V) | IgG1.3f HC | Nucleotide |
| 230 | 13A3 (P102Y) | IgG1.3f HC | Nucleotide |
| 231 | 13A3 (P102L) | IgG1.3f HC | Nucleotide |
| 232 | 13A3 (N60Q, P102Y) | IgG1.3f HC | Nucleotide |
| 357 | 13A3 (N60Q, D101E) | IgG1.3f HC | Nucleotide |
| 233 | 8B9 (S61P) | IgG1.3f HC | Nucleotide |

FIG. 28 (Cont).

| SEQ ID NO. | Antibody | Description | AA/NT |
|---|---|---|---|
| 234 | 9F6 (A108T) | IgG1.3f HC | Nucleotide |
| 235 | 13A3 (N60Q) | IgG1.3f HC (no C-terminal K) | Nucleotide |
| 236 | 13A3 (N60S) | IgG1.3f HC (no C-terminal K) | Nucleotide |
| 237 | 13A3 (N60A) | IgG1.3f HC (no C-terminal K) | Nucleotide |
| 238 | 13A3 (D101E) | IgG1.3f HC (no C-terminal K) | Nucleotide |
| 239 | 13A3 (P102V) | IgG1.3f HC (no C-terminal K) | Nucleotide |
| 240 | 13A3 (P102Y) | IgG1.3f HC (no C-terminal K) | Nucleotide |
| 241 | 13A3 (P102L) | IgG1.3f HC (no C-terminal K) | Nucleotide |
| 242 | 13A3 (N60Q, P102Y) | IgG1.3f HC (no C-terminal K) | Nucleotide |
| 358 | 13A3 (N60Q, D101E) | IgG1.3f HC (no C-terminal K) | Nucleotide |
| 374 | 13A3 (N60Q, D101E) (TIM3.18 ) (T168C) | IgG1.3f HC (no C-terminal K) | Nucleotide |
| 243 | 8B9 (S61P) | IgG1.3f HC (no C-terminal K) | Nucleotide |
| 244 | 9F6 (A108T) | IgG1.3f HC (no C-terminal K) | Nucleotide |
| 245 | 13A3 (N60Q) | VH | Nucleotide |
| 246 | 13A3 (N60S) | VH | Nucleotide |
| 247 | 13A3 (N60A) | VH | Nucleotide |
| 248 | 13A3 (D101E) | VH | Nucleotide |
| 249 | 13A3 (P102V) | VH | Nucleotide |
| 250 | 13A3 (P102Y) | VH | Nucleotide |
| 251 | 13A3 (P102L) | VH | Nucleotide |
| 252 | 13A3 (N60Q, P102Y) | VH | Nucleotide |
| 359 | 13A3 (N60Q, D101E) | VH | Nucleotide |
| 253 | 8B9 (S61P) | VH | Nucleotide |
| 254 | 9F6 (A108T) | VH | Nucleotide |
| 255 | 13A3 (N60Q); 13A3 (N60Q, P102Y); 13A3 (N60Q, D101E) | CDR2 (VH) | Nucleotide |
| 256 | 13A3 (N60S) | CDR2 (VH) | Nucleotide |
| 257 | 13A3 (N60A) | CDR2 (VH) | Nucleotide |
| 258 | 8B9 (S61P) | CDR2 (VH) | Nucleotide |
| 259 | 13A3 (D101E) | CDR3 (VH) | Nucleotide |
| 260 | 13A3 (P102V) | CDR3 (VH) | Nucleotide |
| 261 | 13A3 (P102Y); 13A3 (N60Q, P102Y); 13A3 (N60Q, D101E) | CDR3 (VH) | Nucleotide |
| 262 | 13A3 (P102L) | CDR3 (VH) | Nucleotide |

FIG. 28 (Cont).

| SEQ ID NO. | Antibody | Description | AA/NT |
|---|---|---|---|
| 263 | All antibodies | HC Constant Domain (IgG1.1f) | Nucleotide |
| 264 | All antibodies | HC Constant Domain (IgG1.1f) (no C-terminal K) | Nucleotide |
| 265 | All antibodies | HC Constant Domain (IgG1.3f) | Nucleotide |
| 266 | All antibodies | HC Constant Domain (IgG1.3f) (no C-terminal K) | Nucleotide |
| 267 | | Signal Peptide | amino acid |
| 268 | | Signal Peptide | amino acid |
| 269 | | Signal Peptide | amino acid |
| 270 | | Signal Peptide | amino acid |
| 271 | | Signal Peptide | amino acid |
| 361 | | Signal Peptide (TIM3.2-TIM3.18) | amino acid |
| 272 | | Signal Peptide | Nucleotide |
| 273 | | Signal Peptide | Nucleotide |
| 274 | | Signal Peptide | Nucleotide |
| 275 | | Signal Peptide | Nucleotide |
| 276 | | Signal Peptide | Nucleotide |
| 362 | | Signal Peptide (TIM3.2-TIM3.18 HC) | Nucleotide |
| 363 | | Signal Peptide (TIM3.2-TIM3.18 LC) | Nucleotide |
| 277 | | human IgG1 (allotypic variant) | Amino Acid |
| 278 | | human IgG1 kappa light chain | Amino Acid |
| 279 | | LSPGK (C-terminal end of heavy chain) | Amino Acid |
| 280 | | LSPG (C-terminal end of heavy chain) | Amino Acid |
| 281 | | LSP (C-terminal end of heavy chain) | Amino Acid |
| 282 | | X1X2X3X4YX5X6 (VH CDR1 degenerate) | Amino Acid |
| 283 | | X1IX2X3X4GX5X6X7X8YX9X10X11X12X13X14 (VH CDR2 degenerate) | Amino Acid |
| 284 | | X1X2X3X4X5X6YGX7X8X9X10YGX11X12DX13X14X15X16X17X18 (VH CDR3 degenerate) | Amino Acid |
| 285 | | QQX1X2SX3X4X5T (VL CDR1 degenerate) | Amino Acid |
| 286 | | TIM3 Isoform 1 (aa) | Amino Acid |
| 287 | | TIM3 Isoform 2 (aa) | Amino Acid |
| 288 | | TIM3 Isoform 1 (nt) | Nucleotide |
| 289 | | TIM3 Isoform 2 (nt) | Nucleotide |
| 290 | | Extracellular domain of TIM3 | Amino Acid |
| 291 | | WT human IgG1 constant domain (same as IgG1za) | Amino Acid |
| 292 | | human IgG4 constant domain | Amino Acid |
| 293 | | 9F6 VK2 IgG1 light chain | Amino Acid |
| 294 | | IgG1.1 constant domain (used in anti-TIM3 antibodies) | Amino Acid |
| 295 | | IgG1.3 constant domain (used in anti-TIM3 antibodies) | Amino Acid |
| 296 | | residues 37-43 of mature TIM3 ECD | Amino Acid |
| 297 | | residues 57-83 of mature TIM3 ECD | Amino Acid |
| 298 | | residues 90-99 of mature TIM3 ECD | Amino Acid |

FIG. 28 (Cont).

| SEQ ID NO. | Antibody | Description | AA/NT |
|---|---|---|---|
| 299 |  | residues 1-99 of mature TIM3 ECD | Amino Acid |
| 300 |  | Linker | Amino Acid |
| 360 |  | Cynomolgus TIM3 Protein | Amino Acid |
| 301 | 13A3 | hIgG4 HC | Amino Acid |
| 302 | 13A3 | hIgG4 HC (without C-terminal K) | Amino Acid |
| 303 | TIM3.5 – 13A3 | IgG4P HC | Amino Acid |
| 304 | TIM3.5 – 13A3 | IgG4P HC (without C-terminal K) | Amino Acid |
| 305 | TIM3.10 – 13A3 (N60Q) | IgG4P HC | Amino Acid |
| 306 | TIM3.10 – 13A3 (N60Q) | IgG4P HC (without C-terminal K) | Amino Acid |
| 307 | TIM3.11 – 13A3 (N60S) | IgG4P HC | Amino Acid |
| 308 | TIM3.11 – 13A3 (N60S) | IgG4P HC (without C-terminal K) | Amino Acid |
| 309 | TIM3.12 – 13A3 (N60A) | IgG4P HC | Amino Acid |
| 310 | TIM3.12 – 13A3 (N60A) | IgG4P HC (without C-terminal K) | Amino Acid |
| 311 | TIM3.13 – 13A3 (D101E) | IgG4P HC | Amino Acid |
| 312 | TIM3.13 – 13A3 (D101E) | IgG4P HC (without C-terminal K) | Amino Acid |
| 313 | TIM 3.14 – 13A3 (P102V) | IgG4P HC | Amino Acid |
| 314 | TIM 3.14 – 13A3 (P102V) | IgG4P HC (without C-terminal K) | Amino Acid |
| 315 | TIM3.15 – 13A3 (P102Y) | IgG4P HC | Amino Acid |
| 316 | TIM3.15 – 13A3 (P102Y) | IgG4P HC (without C-terminal K) | Amino Acid |
| 317 | TIM3.16 – 13A3 (P102L) | IgG4P HC | Amino Acid |
| 318 | TIM3.16 – 13A3 (P102L) | IgG4P HC (without C-terminal K) | Amino Acid |
| 319 | TIM3.17 – 13A3 (N60Q, P102Y) | IgG4P HC | Amino Acid |
| 320 | TIM3.17 – 13A3 (N60Q, P102Y) | IgG4P HC (without C-terminal K) | Amino Acid |
| 353 | TIM3.18 – 13A3 (N60Q, D101E) | IgG4P HC | Amino Acid |
| 354 | TIM3.18 – 13A3 (N60Q, D101E) | IgG4P HC (without C-terminal K) | Amino Acid |
| 321 | 8B9 | IgG1za HC | Amino Acid |
| 322 | 8B9 | IgG1za HC (without C-terminal K) | Amino Acid |
| 323 | 8B9 | IgG4P HC | Amino Acid |
| 324 | 8B9 | IgG4P HC (without C-terminal K) | Amino Acid |
| 325 | TIM3.8 – 8B9 | IgG4P HC | Amino Acid |

FIG. 28 (Cont).

| SEQ ID NO. | Antibody | Description | AA/NT |
|---|---|---|---|
| | (S61P) | | |
| 326 | TIM3.8 – 8B9 (S61P) | IgG4P HC (without C-terminal K) | Amino Acid |
| 327 | 8C4 | IgG1za HC | Amino Acid |
| 328 | 8C4 | IgG1za HC (without C-terminal K) | Amino Acid |
| 329 | TIM3.6 – 8C4 | IgG4P HC | Amino Acid |
| 330 | TIM3.6 – 8C4 | IgG4P HC (without C-terminal K) | Amino Acid |
| 331 | 17C3 | IgG1za HC | Amino Acid |
| 332 | 17C3 | IgG1za HC (without C-terminal K) | Amino Acid |
| 333 | TIM3.2 – 17C3 | IgG4P HC | Amino Acid |
| 334 | TIM3.2 – 17C3 | IgG4P HC (without C-terminal K) | Amino Acid |
| 335 | 9F6 | IgG1za HC | Amino Acid |
| 336 | 9F6 | IgG1za HC (without C-terminal K) | Amino Acid |
| 337 | 9F6 | IgG4P HC | Amino Acid |
| 338 | 9F6 | IgG4P HC (without C-terminal K) | Amino Acid |
| 339 | TIM3.7 – 9F6 (A108T) | IgG4P HC | Amino Acid |
| 340 | TIM3.7 – 9F6 (A108T) | IgG4P HC (without C-terminal K) | Amino Acid |
| 341 | 3G4 | IgG1za HC | Amino Acid |
| 342 | 3G4 | IgG1za HC (without C-terminal K) | Amino Acid |
| 343 | TIM3.4 – 3G4 | IgG4P HC | Amino Acid |
| 344 | TIM3.4 – 3G4 | IgG4P HC (without C-terminal K) | Amino Acid |
| 345 | 17C8 | IgG4 HC | Amino Acid |
| 346 | 17C8 | IgG4 HC | Amino Acid |
| 347 | TIM3.9 – 17C8 | IgG4P HC | Amino Acid |
| 348 | TIM3.9 – 17C8 | IgG4P HC (without C-terminal K) | Amino Acid |
| 365 | 13A3 | Heavy Chain Fab 6X His | Amino Acid |
| 366 | TIM3.18 – 13A3 (N60Q, D101E) | Heavy Chain ab 6X His | Amino Acid |
| 367 | | Residues 49-62 of Mature Human TIM3 Extracellular Domain | Amino Acid |
| 368 | | Residues 111-127 of Mature Human TIM3 Extracellular Domain | Amino Acid |
| 369 | | Residues 40-62 of Mature Human TIM3 Extracellular Domain | Amino Acid |
| 370 | | Residues 66-77 of Mature Human TIM3 Extracellular Domain | Amino Acid |
| 371 | | Residues 78-95 of Mature Human TIM3 Extracellular Domain | Amino Acid |
| 372 | | Residues 110-127 of Mature Human TIM3 Extracellular Domain | Amino Acid |
| 373 | | Residues 119-127 of Mature Human TIM3 Extracellular Domain | Amino Acid |
| 375 | | hTIM3-mFc | Amino Acid |
| 376 | | Cyno TIM3-MycHisAvi | Amino Acid |
| 377 | | hTIM3_IgV | Amino Acid |

FIG. 28 (Cont).

| SEQ ID NO. | Antibody | Description | AA/NT |
|---|---|---|---|
| 378 | TIM3.18 – 13A3 (N60Q, D101E) | IgG1.3f HC with signal peptide | Amino Acid |
| 379 | TIM3.18 – 13A3 (N60Q, D101E) | IgG1.3f HC (no C-terminal K) with signal peptide | Amino Acid |
| 380 | TIM3.18 – 13A3 (N60Q, D101E) | IgG1.3f HC with signal sequence | Nucleotide |
| 381 | TIM3.18 – 13A3 (N60Q, D101E) | IgG1.3f HC (no C-terminal K) with signal sequence | Nucleotide |
| 382 | TIM3.18 – 13A3 (N60Q, D101E) | IgG1.3f HC (T168C) with signal sequence | Nucleotide |
| 383 | TIM3.18 – 13A3 (N60Q, D101E) | IgG1.3f HC (T168C) (no C-terminal K) with signal sequence | Nucleotide |
| 384 | TIM3.18 – 13A3 (N60Q, D101E) | LC with signal peptide | Amino Acid |
| 385 | TIM3.18 – 13A3 (N60Q, D101E) | LC with signal sequence | Nucleotide |
| 386 | 14H7 | hIgG4 HC | Amino Acid |
| 387 | 14H7 | hIgG4 HC (without C-terminal K) | Amino Acid |
| 388 | TIM3.24 – 14H7 | IgG1.1f HC | Amino Acid |
| 389 | TIM3.24 – 14H7 | IgG1.1 HC (without C-terminal K) | Amino Acid |
| 390 | TIM3.24 – 14H7 | IgG1.3f HC | Amino Acid |
| 391 | TIM3.24 – 14H7 | IgG1.3f HC (without C-terminal K) | Amino Acid |
| 392 | TIM3.24 – 14H7 | IgG4P HC | Amino Acid |
| 393 | TIM3.24 – 14H7 | IgG4P HC (without C-terminal K) | Amino Acid |
| 394 | 23B3 | hIgG4 HC | Amino Acid |
| 395 | 23B3 | hIgG4 HC (without C-terminal K) | Amino Acid |
| 396 | 23B3 | IgG1.1f HC | Amino Acid |
| 397 | 23B3 | IgG1.1 HC (without C-terminal K) | Amino Acid |
| 398 | 23B3 | IgG1.3f HC | Amino Acid |
| 399 | 23B3 | IgG1.3f HC (without C-terminal K) | Amino Acid |
| 400 | 23B3 | IgG4P HC | Amino Acid |
| 401 | 23B3 | IgG4P HC (without C-terminal K) | Amino Acid |
| 402 | TIM3.25 – (23B3-VH-G6E-D79Y) | IgG1.1f HC | Amino Acid |
| 403 | TIM3.25 – (23B3-VH-G6E-D79Y) | IgG1.1 HC (without C-terminal K) | Amino Acid |
| 404 | TIM3.25 – (23B3-VH-G6E-D79Y) | IgG1.3f HC | Amino Acid |
| 405 | TIM3.25 – (23B3-VH-G6E-D79Y) | IgG1.3f HC (without C-terminal K) | Amino Acid |
| 406 | TIM3.25 – (23B3-VH-G6E-D79Y) | IgG4P HC | Amino Acid |
| 407 | TIM3.25 – (23B3-VH-G6E-D79Y) | IgG4P HC (without C-terminal K) | Amino Acid |
| 408 | TIM3.24 – 14H7 | LC | Amino Acid |
| 409 | 23B3 | LC (VK2) | Amino Acid |

FIG. 28 (Cont).

| SEQ ID NO. | Antibody | Description | AA/NT |
|---|---|---|---|
| 410 | 14H7 and TIM3.24 | VH | Amino Acid |
| 411 | 23B3 | VH | Amino Acid |
| 412 | TIM3.25 – (23B3-VH-G6E-D79Y) | VH | Amino Acid |
| 413 | 14H7 and TIM3.24 | CDR2 (VH) | Amino Acid |
| 414 | 14H7 and TIM3.24 | CDR3 (VH) | Amino Acid |
| 415 | 23B3 and TIM3.25 – (23B3-VH-G6E-D79Y) | CDR2 (VH) | Amino Acid |
| 416 | 23B3 and TIM3.25 – (23B3-VH-G6E-D79Y) | CDR3 (VH) | Amino Acid |
| 417 | 14H7 | VL | Amino Acid |
| 418 | 23B3 | VL (VK2) | Amino Acid |
| 419 | 23B3 | CDR3 (VL) (VK2) | Amino Acid |
| 445 | 14H7 | hIgG4 HC | Nucleotide |
| 446 | 14H7 | hIgG4 HC (without C-terminal K) | Nucleotide |
| 430 | TIM3.24 – 14H7 | IgG1.1f HC | Nucleotide |
| 431 | TIM3.24 – 14H7 | IgG1.1 HC (without C-terminal K) | Nucleotide |
| 432 | TIM3.24 – 14H7 | IgG1.3f HC | Nucleotide |
| 433 | TIM3.24 – 14H7 | IgG1.3f HC (without C-terminal K) | Nucleotide |
| xx | TIM3.24 – 14H7 | IgG4P HC | Nucleotide |
| xx | TIM3.24 – 14H7 | IgG4P HC (without C-terminal K) | Nucleotide |
| 447 | 23B3 | hIgG4 HC | Nucleotide |
| 448 | 23B3 | hIgG4 HC (without C-terminal K) | Nucleotide |
| 434 | 23B3 | IgG1.1f HC | Nucleotide |
| 435 | 23B3 | IgG1.1 HC (without C-terminal K) | Nucleotide |
| 436 | 23B3 | IgG1.3f HC | Nucleotide |
| 437 | 23B3 | IgG1.3f HC (without C-terminal K) | Nucleotide |
| xx | 23B3 | IgG4P HC | Nucleotide |
| xx | 23B3 | IgG4P HC (without C-terminal K) | Nucleotide |
| 438 | TIM3.25 – (23B3-VH-G6E-D79Y) | IgG1.1f HC | Nucleotide |
| 439 | TIM3.25 – (23B3-VH-G6E-D79Y) | IgG1.1 HC (without C-terminal K) | Nucleotide |
| 440 | TIM3.25 – (23B3-VH-G6E-D79Y) | IgG1.3f HC | Nucleotide |
| 441 | TIM3.25 – (23B3-VH-G6E-D79Y) | IgG1.3f HC (without C-terminal K) | Nucleotide |
| xx | TIM3.25 – (23B3-VH-G6E-D79Y) | IgG4P HC | Nucleotide |
| xx | TIM3.25 – (23B3-VH-G6E-D79Y) | IgG4P HC (without C-terminal K) | Nucleotide |
| 442 | TIM3.24 – 14H7 | LC | Nucleotide |

FIG. 28 (Cont).

| SEQ ID NO. | Antibody | Description | AA/NT |
|---|---|---|---|
| 443 | 23B3 | LC (VK1) | Nucleotide |
| 444 | 23B3 | LC (VK2) | Nucleotide |
| 420 | 14H7 and TIM3.24 | VH | Nucleotide |
| 421 | 23B3 | VH | Nucleotide |
| 422 | TIM3.25 – (23B3-VH-G6E-D79Y) | VH | Nucleotide |
| 423 | 14H7 and TIM3.24 | CDR2 (VH) | Nucleotide |
| 424 | 14H7 and TIM3.24 | CDR3 (VH) | Nucleotide |
| 425 | 23B3 and TIM3.25 – (23B3-VH-G6E-D79Y) | CDR2 (VH) | Nucleotide |
| 426 | 23B3 and TIM3.25 – (23B3-VH-G6E-D79Y) | CDR3 (VH) | Nucleotide |
| 427 | 14H7 | VL | Nucleotide |
| 428 | 23B3 | VL (VK2) | Nucleotide |
| 429 | 23B3 | CDR3 (VL) (VK2) | Nucleotide |

13A3

$^{49}$VPVCWGKGACPVFE$^{62}$ $^{111}$RIQIPGIMNDEKFNLKL$^{127}$

3G4

$^{40}$VTPAAPGNLVPVCWGKGAC$^{58}$
$^{49}$VPVCWGKGACPVFE$^{62}$ $^{66}$VVVLRTDERDVNY$^{77}$
$^{78}$WTSRYWLNGDFRKGDVSL$^{95}$ $^{111}$RIQIPGIMNDEKFNLKL$^{127}$

ANTIBODIES AGAINST TIM3 AND USES THEREOF

REFERENCE TO SEQUENCE LISTING SUBMITTED ELECTRONICALLY VIA EFS-WEB

The content of the electronically submitted sequence listing in ASCII text file (Name: 3338_0980001_Seqlisting_ST25.txt; Size 913,028 bytes; and Date of Creation: Jul. 10, 2020) filed with the application is herein incorporated by reference in its entirety.

BACKGROUND OF THE DISCLOSURE

T-cell immunoglobulin and mucin-domain containing-3 (TIM3), also known as hepatitis A virus cellular receptor 2 (HAVCR2), is a type-I transmembrane protein that functions as a key regulator of immune responses. TIM3 was initially identified on activated IFN-γ producing T cells (e.g., type 1 helper $CD4^+$ T cells and cytotoxic $CD8^+$ T cells) and shown to induce T cell death or exhaustion after binding to galectin-9. More recent studies have indicated that TIM3 expression is also important in regulating the activities of many innate immune cells (e.g., macrophages, monocytes, dendritic cells, mast cells, and natural killer cells). See Han G et al., *Front Immunol.* 4: 449 (2013).

Like many inhibitory receptors (e.g., PD-1 and CTLA-4), TIM3 expression has been associated with many types of chronic diseases, including cancer. $TIM3^+$ T cells have been detected in patients with advanced melanoma, non-small cell lung cancer, or follicular B-cell non-Hodgkin lymphoma. And the presence of $TIM3^+$ regulatory T cells have been described as an effective indicator of lung cancer progression. See Anderson A C. *Cancer Immunol Res.* 2: 393-8 (2014).

Several potential ligands for TIM3 have been identified: Galectin-9, HMGB1, Semaphorin-4A, CEACAM-1, ILT-4 and phosphatidylserine (PtdSer or PS). PS is an important cell membrane component, and is normally localized to the inner leaflet of cell membranes. But as a cell undergoes apoptosis, PS is redistributed and exposed to the outer membrane. This redistribution is also observed in many tumor cell lines. See Riedl S et al., *Biochim Biophys Acta.* 1808: 2638-2645 (2011). Binding of TIM3 to PS may be critical for phagocytosis and cross-presentation. See Nakayama M et al., *Blood.* 113: 3821-30 (2009).

Studies have shown a close relationship between TIM3 and the inhibitory receptor PD-1. For example, many tumor-specific T cells express both PD-1 and TIM3, and these T cells have been shown to be more dysfunctional compared to T cells that express only PD-1 or TIM3. See Fourcade J et al., *J Exp Med.* 207: 2175-2186 (2010).

Accordingly, agents that target TIM3, and methods of using such agents, are highly desirable for designing new cancer immunotherapies and improving traditional cancer immunotherapies.

SUMMARY OF THE DISCLOSURE

Provided herein are isolated antibodies such as monoclonal antibodies, or antigen binding portion thereof, in particular human (e.g., monoclonal) antibodies, which bind specifically to human T-cell immunoglobulin and mucin-domain containing-3 (TIM3) ("anti-TIM3 antibody") and comprise a heavy chain CDR1, CDR2, and CDR3 and a light chain CDR1, CDR2, and CDR3. In some embodiments, the heavy chain CDR3 comprises SEQ ID NO: 414 or SEQ ID NO: 416. In some embodiments, the heavy chain CDR1 comprises SEQ ID NO: 45. In some embodiments, the heavy chain CDR2 comprises SEQ ID NO: 413 or SEQ ID NO: 415. In some embodiments, the light chain CDR1 comprises SEQ ID NO: 64. In some embodiments, the light chain CDR2 comprises SEQ ID NO: 66. In some embodiments, the light chain CDR3 comprises SEQ ID NO: 69, SEQ ID NO: 68, or SEQ ID NO: 419.

In some embodiments, the anti-TIM3 antibody, or antigen binding portion thereof, comprises a heavy chain CDR1, CDR2, and CDR3 and a light chain CDR1, CDR2, and CDR3, wherein:
(a) the heavy chain CDR1 comprises SEQ ID NO: 45;
(b) the heavy chain CDR2 comprises SEQ ID NO: 413 or SEQ ID NO: 415;
(c) the heavy chain CDR3 comprises SEQ ID NO: 414 or SEQ ID NO: 416;
(d) the light chain CDR1 comprises SEQ ID NO: 64;
(e) the light chain CDR2 comprises SEQ ID NO: 66; and
(f) the light chain CDR3 comprises SEQ ID NO: 69, SEQ ID NO: 68, or SEQ ID NO: 419.

In some embodiments, (a) the heavy chain CDR1, CDR2, and CDR3 comprise SEQ ID NOs: 45, 413, and 414, respectively, and the light chain CDR1, CDR2, and CDR3 comprise SEQ ID NOs: 64, 66, and 69, respectively; (b) the heavy chain CDR1, CDR2, and CDR3 comprise SEQ ID NOs: 45,415, and 416, respectively, and the light chain CDR1, CDR2, and CDR3 comprise SEQ ID NOs: 64, 66, and 68, respectively; or (c) the heavy chain CDR1, CDR2, and CDR3 comprise SEQ ID NOs: 45, 415, and 416, respectively, and the light chain CDR1, CDR2, and CDR3 comprise SEQ ID NOs: 64, 66, and 419, respectively.

In some embodiments, the heavy chain CDR1, CDR2, and CDR3 comprise SEQ ID NOs: 45, 413, and 414, respectively, and the light chain CDR1, CDR2, and CDR3 comprise SEQ ID NOs: 64, 66, and 69, respectively. In some embodiments, the heavy chain CDR1, CDR2, and CDR3 comprise SEQ ID NOs: 45,415, and 416, respectively, and the light chain CDR1, CDR2, and CDR3 comprise SEQ ID NOs: 64, 66, and 68, respectively. In some embodiments, the heavy chain CDR1, CDR2, and CDR3 comprise SEQ ID NOs: 45, 415, and 416, respectively, and the light chain CDR1, CDR2, and CDR3 comprise SEQ ID NOs: 64, 66, and 419, respectively.

In some embodiments, the anti-TIM3 antibody, or antigen binding portion thereof, comprises a heavy chain variable region (VH) and a light chain variable region (VL), wherein the VH comprises an amino acid sequence which is at least about 80%, at least about 85%, at least about 90%, at least about 95%, at least about 96%, at least about 97%, at least about 98%, at least about 99%, or about 100% identical to the amino acid sequence set forth as SEQ ID NO: 410.

In some embodiments, the anti-TIM3 antibody, or antigen binding portion thereof, comprises a heavy chain variable region (VH) and a light chain variable region (VL), wherein the VH comprises an amino acid sequence which is at least about 80%, at least about 85%, at least about 90%, at least about 95%, at least about 96%, at least about 97%, at least about 98%, at least about 99%, or about 100% identical to the amino acid sequence set forth as SEQ ID NO: 411.

In some embodiments, the anti-TIM3 antibody, or antigen binding portion thereof, comprises a heavy chain variable region (VH) and a light chain variable region (VL), wherein the VH comprises an amino acid sequence which is at least about 80%, at least about 85%, at least about 90%, at least about 95%, at least about 96%, at least about 97%, at least about 98%, at least about 99%, or about 100% identical to the amino acid sequence set forth as SEQ ID NO: 412.

In some embodiments, the anti-TIM3 antibody, or antigen binding portion thereof, cross-competes for binding to TIM3 with a reference antibody comprising:
- (a) a heavy chain variable region (VH) comprising SEQ ID NO: 410 and a light chain variable region (VL) comprising SEQ ID NO: 417;
- (b) a heavy chain variable region (VH) comprising SEQ ID NO: 411 and a light chain variable region (VL) comprising SEQ ID NO: 60;
- (c) a heavy chain variable region (VH) comprising SEQ ID NO: 411 and a light chain variable region (VL) comprising SEQ ID NO: 418; or
- (d) a heavy chain variable region (VH) comprising SEQ ID NO: 412 and a light chain variable region (VL) comprising SEQ ID NO: 60.

In some embodiments, the anti-TIM3 antibody, or antigen binding portion thereof, comprises:
- (a) a heavy chain CDR1, CDR2, and CDR3 of a heavy chain variable region (VH) comprising SEQ ID NO: 410 and a light chain CDR1, CDR2, and CDR3 of a light chain variable region (VL) comprising SEQ ID NO: 417;
- (b) a heavy chain CDR1, CDR2, and CDR3 of a heavy chain variable region (VH) comprising SEQ ID NO: 411 and a light chain CDR1, CDR2, and CDR3 of a light chain variable region (VL) comprising SEQ ID NO: 60;
- (c) a heavy chain CDR1, CDR2, and CDR3 of a heavy chain variable region (VH) comprising SEQ ID NO: 411 and a light chain CDR1, CDR2, and CDR3 of a light chain variable region (VL) comprising SEQ ID NO: 418; or
- (d) a heavy chain CDR1, CDR2, and CDR3 of a heavy chain variable region (VH) comprising SEQ ID NO: 412 and a light chain CDR1, CDR2, and CDR3 of a light chain variable region (VL) comprising SEQ ID NO: 60.

In some embodiments, the anti-TIM3 antibody, or antigen binding portion thereof, binds to the same epitope as a reference antibody, as determined by HDX, comprising:
- (a) a heavy chain variable region (VH) comprising SEQ ID NO: 410 and a light chain variable region (VL) comprising SEQ ID NO: 417;
- (b) a heavy chain variable region (VH) comprising SEQ ID NO: 411 and a light chain variable region (VL) comprising SEQ ID NO: 60;
- (c) a heavy chain variable region (VH) comprising SEQ ID NO: 411 and a light chain variable region (VL) comprising SEQ ID NO: 418 or
- (d) a heavy chain variable region (VH) comprising SEQ ID NO: 412 and a light chain variable region (VL) comprising SEQ ID NO: 60.

In some embodiments, the anti-TIM3 antibody, or antigen binding portion thereof, comprises:
- (a) a heavy chain CDR1, CDR2, and CDR3 of a heavy chain variable region (VH) comprising SEQ ID NO: 410 and a light chain CDR1, CDR2, and CDR3 of a light chain variable region (VL) comprising SEQ ID NO: 417;
- (b) a heavy chain CDR1, CDR2, and CDR3 of a heavy chain variable region (VH) comprising SEQ ID NO: 411 and a light chain CDR1, CDR2, and CDR3 of a light chain variable region (VL) comprising SEQ ID NO: 60;
- (c) a heavy chain CDR1, CDR2, and CDR3 of a heavy chain variable region (VH) comprising SEQ ID NO: 411 and a light chain CDR1, CDR2, and CDR3 of a light chain variable region (VL) comprising SEQ ID NO: 418; or
- (d) a heavy chain CDR1, CDR2, and CDR3 of a heavy chain variable region (VH) comprising SEQ ID NO: 412 and a light chain CDR1, CDR2, and CDR3 of a light chain variable region (VL) comprising SEQ ID NO: 60.

In some embodiments, the anti-TIM3 antibody, or antigen binding portion thereof, comprises a VH and a VL, wherein the VH comprises SEQ ID NO: 410 and the VL comprises SEQ ID NO: 417. In some embodiments, the VH comprises SEQ ID NO: 411 and the VL comprises SEQ ID NO: 60. In some embodiments, the VH comprises SEQ ID NO: 411 and the VL comprises SEQ ID NO: 418. In some embodiments, the VH comprises SEQ ID NO: 412 and the VL comprises SEQ ID NO: 60.

In some embodiments, the anti-TIM3 antibody, or antigen binding portion thereof, is selected from the group consisting of an IgG1, an IgG2, an IgG3, an IgG4, and a variant thereof. In some embodiments, the anti-TIM3 antibody, or antigen binding portion thereof, is an IgG1 antibody. In some embodiments, the anti-TIM3 antibody, or antigen binding portion thereof, comprises an effectorless IgG1 Fc.

In some embodiments, the anti-TIM3 antibody, or antigen binding portion thereof, comprises
- (a1) heavy and light chain sequences comprising SEQ ID NOs: 386 (or 387) and 408, respectively;
- (a2) heavy and light chain sequences comprising SEQ ID NOs: 388 (or 389) and 408, respectively;
- (a3) heavy and light chain sequences comprising SEQ ID NOs: 390 (or 391) and 408, respectively;
- (a4) heavy and light chain sequences comprising SEQ ID NOs: 392 (or 393) and 408, respectively;
- (b1) heavy and light chain sequences comprising SEQ ID NOs: 394 (or 395) and 29, respectively;
- (b2) heavy and light chain sequences comprising SEQ ID NOs: 394 (or 395) and 409, respectively;
- (b3) heavy and light chain sequences comprising SEQ ID NOs: 396 (or 397) and 29, respectively;
- (b4) heavy and light chain sequences comprising SEQ ID NOs: 398 (or 399) and 29, respectively;
- (b5) heavy and light chain sequences comprising SEQ ID NOs: 400 (or 401) and 29, respectively;
- (b6) heavy and light chain sequences comprising SEQ ID NOs: 402 (or 403) and 29, respectively;
- (b7) heavy and light chain sequences comprising SEQ ID NOs: 404 (or 405) and 29, respectively; or
- (b8) heavy and light chain sequences comprising SEQ ID NOs: 406 (or 407) and 29, respectively.

In some embodiments, the anti-TIM3 antibody, or antigen binding portion thereof, has one or more of the following properties:
- (1) binding to membrane bound human TIM3, e.g., with an $EC_{50}$ of 1 µg/mL or less (e.g., 0.01 µg/mL to 0.05 µg/mL), e.g., as measured by flow cytometry;
- (2) binding to membrane bound cyno TIM3, e.g., as measured by flow cytometry;
- (3) binding to hTIM3-IgV with a $K_D$ of $5\times10^{-8}$ M, $2\times10^{-8}$ M, $10^{-8}$ M or $5\times10^{-9}$ M or less, as determined by the method described in Example 22;
- (4) binding to hTIM3-IgV with a $K_D$ of $10^{-7}$ M, $2\times10^{-8}$ M or $10^{-8}$ M or less, as determined by the method described in Example 22;

(5) binding to cynoTIM3-ECD with a $K_D$ of $5\times10^{-7}$ M, $2\times10^{-8}$ M or $10^{-8}$ M or less, as determined by the method described in Example 22;
(6) binding to hTIM3-ECD with a $K_D$ of $8\times10^{-8}$ M, $5\times10^{-8}$ M or $10^{-8}$ M or less, as determined by the method described in Example 22;
(7) inducing or enhancing T cell activation (e.g., by blocking or reducing the inhibitory effect of TIM3), as evidenced by enhanced proliferation of TIM3-expressing T cells (e.g., Th1 cells or TILs); and/or
(8) competing in either direction or both direction for binding to human TIM3 with an antibody comprising a VH and VL of any one of 14H7, 23B3, 13A3, TIM3.7, TIM3.10, TIM3.11, TIM3.12, TIM3.13, TIM3.14, TIM3.15, TIM3.16, TIM3.17, TIM3.18, TIM3.20, TIM3.21, TIM3.22, TIM3.23, TIM3.24, TIM3.25, 17C3, 9F6, TIM3.7, 3G4, and 17C8.

In some embodiments, the anti-TIM3 antibody comprises: (i) VH CDR1, CDR2 and CDR3 comprising SEQ ID NOs: 45, 415 and 416, respectively, and VL CDR1, CDR2 and CDR3 comprising SEQ ID NOs: 64, 66 and 68, respectively; or (ii) VH comprising SEQ ID NO: 412 and VL comprising SEQ ID NO: 60; wherein the antibody binds to human TIM3-IgV with a KD of $5\times10^{-9}$ M or less; binds to cyno TIM3-IgV with a KD of $10^{-7}$ M or less; and/or binds to cyno TIM3-ECD with a KD of $5\times10^{-6}$ M or less.

In some embodiments, the anti-TIM3 antibody comprises: (i) VH CDR1, CDR2 and CDR3 comprising SEQ ID NOs: 45, 413 and 414, respectively, and VL CDR1, CDR2 and CDR3 comprising SEQ ID NOs: 64, 66 and 69, respectively; or (ii) VH comprising SEQ ID NO: 410 and VL comprising SEQ ID NO: 417; wherein the antibody binds to human TIM3-IgV with a KD of $5\times10^{-8}$ M or less; binds to cyno TIM3-IgV with a KD of $5\times10^{-9}$ M or less; and/or binds to cyno TIM3-ECD with a KD of $5\times10^{-9}$ M or less.

In some embodiments, the heavy chain of the anti-TIM3 antibody disclosed herein comprises a C-terminal lysine. In other embodiments, the heavy chain of the anti-TIM3 antibody does not comprise a C-terminal lysine.

Provided herein are bispecific molecules comprising an anti-TIM3 antibody, or antigen binding portion thereof, of the present disclosure linked to a molecule having a second binding specificity.

Provided herein are nucleic acids encoding the VH and/or VL of the anti-TIM3 antibody, or antigen binding portion thereof, expression vectors comprising the nucleic acids, and cells transformed with the expression vectors.

Provided herein are immunoconjugates comprising the anti-TIM3 antibody, or antigen binding portion thereof, described herein, linked to an agent.

Provided herein are compositions comprising anti-TIM3 antibodies, or antigen binding portions thereof, bispecific molecules, or immunoconjugates described herein, and a carrier. Also provided herein are kits comprising the anti-TIM3 antibodies, or antigen binding portions thereof, bispecific molecules, or immunoconjugates described herein, and instructions for use.

Provided herein is a method of preparing an anti-TIM3 antibodies, or antigen binding portions thereof, comprising expressing an anti-TIM3 antibody, or antigen binding portion thereof, in a cell and isolating the antibody, or antigen binding portion thereof, from the cell.

Provided herein is a method of stimulating an antigen-specific T cell response comprising contacting the T cell with an anti-TIM3 antibody, or antigen binding portion thereof, bispecific molecule, or immunoconjugate described herein such that an antigen-specific T cell response is stimulated (e.g., by inhibiting the negative effect of TIM3 on cells, e.g., T cells).

Provided herein is a method of activating or co-stimulating a T cell, e.g., an effector T cell (e.g., Th1 cell), comprising contacting a cell, e.g., an effector T cell, with an anti-TIM3 antibody, or antigen binding portion thereof, bispecific molecule, or immunoconjugate described herein, and CD3, wherein the effector T cell is activated or co-stimulated (e.g., by inhibiting the negative effect of TIM3 on cells, e.g., T cells).

Provided herein is a method of increasing IFN-γ production in and/or proliferation of a T cell, e.g., Th1 cell or TIL, comprising contacting the T cell with an effective amount of an anti-TIM3 antibody, or antigen binding portion thereof, bispecific molecule, or immunoconjugate described herein.

Provided herein is a method of increasing IFN-γ production in T cells in a subject comprising administering to the subject an effective amount of an anti-TIM3 antibody, or antigen binding portion thereof, bispecific molecule, or immunoconjugate described herein to increase IFN-γ production from the T cells.

Provided herein is a method of stimulating TIL activity in a subject comprising administering to the subject a therapeutically effective amount of an anti-TIM3 antibody, or antigen binding portion thereof, described herein, such that the TILs proliferate or secrete a cytokine, e.g., IFN-γ.

Provided herein is a method for stimulating NK cells (e.g., by increasing NK cell cytotoxic activity) and/or macrophages or other antigen presenting cell in a subject, comprising administering to the subject an effective amount of an anti-TIM3 antibody, or antigen binding portion thereof, bispecific molecule, or immunoconjugate described herein. For example, an anti-TIM3 antibody described herein can increase IL-12 secretion by antigen presenting cells contacted with the TIM3 antibody.

Provided herein is a method of stimulating an immune response in a subject comprising administering to the subject an anti-TIM3 antibody, or antigen binding portion thereof, bispecific molecule, or immunoconjugate described herein, such that an immune response in the subject is stimulated. In some embodiments, the subject has a tumor and an immune response against the tumor is stimulated.

Provided herein is a method for inhibiting the growth of tumors or reducing the size of tumors in a subject comprising administering to the subject an anti-TIM3 antibody, or antigen binding portion thereof, bispecific molecule, or immunoconjugate described herein, such that growth of the tumor is inhibited in the subject.

Provided herein is a method of treating cancer, e.g., by immunotherapy, comprising administering to a subject in need thereof a therapeutically effective amount of an anti-TIM3 antibody, or antigen binding portion thereof, bispecific molecule, or immunoconjugate described herein to treat the cancer. In some embodiments, the cancer is selected from the group consisting of: bladder cancer, breast cancer, uterine/cervical cancer, ovarian cancer, prostate cancer, testicular cancer, esophageal cancer, gastrointestinal cancer, pancreatic cancer, colorectal cancer, colon cancer, kidney cancer, head and neck cancer, lung cancer, stomach cancer, germ cell cancer, bone cancer, liver cancer, thyroid cancer, skin cancer, neoplasm of the central nervous system, lymphoma, leukemia, myeloma, sarcoma, virus-related cancer, and any combinations thereof. In some embodiments, the cancer is a metastatic cancer, refractory cancer, or recurrent cancer. In some embodiments, the cancer is a cold tumor.

In some embodiments, the methods described herein further comprise administering one or more additional therapeutics with an anti-TIM3 antibody, e.g., an anti-PD-1 antibody, an anti-LAG-3 antibody, an anti-CTLA4 antibody, an anti-GITR antibody, and/or an anti-PD-L1 antibody.

Provided herein is a method of detecting the presence of a TIM3 protein in a sample comprising contacting the sample with an anti-TIM3 antibody, or antigen binding portion thereof, under conditions that allow for formation of a complex between the antibody, or antigen binding portion thereof, and TIM3, and detecting the formation of a complex.

EMBODIMENTS

Embodiment 1. An isolated antibody (e.g., a human antibody), or antigen binding portion thereof, which binds to human T-cell immunoglobulin and mucin-domain containing-3 (TIM3) and exhibits the following properties:
(a) binds to soluble human TIM3;
(b) binds to membrane bound human TIM3;
(c) induces or enhances T cell activation; and optionally:
(d) binds to soluble cynomolgus TIM3; and
(e) binds to membrane cynomolgus TIM3.

Embodiment 2. The antibody, or antigen binding portion thereof, of Embodiment 1, wherein the antibody stimulates an anti-tumor immune response.

Embodiment 3. The antibody, or antigen binding portion thereof, of Embodiment 1 or 2, wherein the antibody stimulates an antigen-specific T cell response.

Embodiment 4. The antibody, or antigen binding portion thereof, of any one of the preceding Embodiments, wherein the antibody increases IFN-γ production in TIM3-expressing T cells.

Embodiment 5. The antibody, or antigen binding portion thereof, of any one of the preceding Embodiments, wherein the antibody increases T cell proliferation.

Embodiment 6. The antibody, or antigen binding portion thereof, of any one of the preceding Embodiments, wherein the antibody does not bind to Fc receptors, or wherein the antibody lacks effector function.

Embodiment 7. The antibody, or antigen binding portion thereof, of any one of the preceding Embodiments, wherein the antibody binds to soluble human TIM3 with a $K_D$ of 10 nM or less as measured by Biacore.

Embodiment 8. The antibody, or antigen binding portion thereof, of any one of the preceding Embodiments, wherein the antibody binds to soluble cynomolgus TIM3 with a $K_D$ of 100 nM or less as measured by Biacore.

Embodiment 9. The antibody, or antigen binding fragment thereof, of any one of the preceding Embodiments, wherein the antibody is an antagonist antibody that inhibits negative cell (e.g., T cell) signaling by TIM3.

Embodiment 10. The antibody, or antigen binding portion thereof, of any one of the preceding Embodiments, wherein the antibody binds to membrane bound human TIM3 with an $EC_{50}$ of 0.1 or 1 µg/mL or less as measured by flow cytometry.

Embodiment 11. The antibody, or antigen binding portion thereof, of any one of the preceding Embodiments, wherein the antibody binds to membrane bound human TIM3 with $K_D$ of 1 nM or less as measured by Scatchard analysis.

Embodiment 12. The antibody, or antigen binding portion thereof, of any one of the preceding Embodiments, wherein the antibody binds to membrane bound cynomolgus TIM3 with an $EC_{50}$ of 1 µg/mL or less as measured by flow cytometry, or wherein the antibody binds to membrane bound cyno TIM3 with $K_D$ of 1 nM or less as measured by Scatchard analysis.

Embodiment 13. The antibody, or antigen binding portion thereof, of any one of the preceding Embodiments, wherein the antibody, or antigen binding portion thereof, comprises heavy chain CDR1, CDR2, and CDR3 and light chain CDR1, CDR2, and CDR3, wherein the heavy chain CDR3 comprises an amino acid sequence selected from the group consisting of: SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 126, SEQ ID NO: 127, SEQ ID NO: 128, or SEQ ID NO: 129.

Embodiment 14. The antibody, or antigen binding portion thereof, of Embodiment 13, wherein the heavy chain CDR1 comprises X1, X2, X3, X4, Y, X5, and X6, and wherein X1 is S or none, X2 is R or none, X3 is S, R, or D, X4 is Y or H, X5 is W or M, and X6 is G, N, S, or H.

Embodiment 15. The antibody, or antigen binding portion thereof, of Embodiment 13 or 14, wherein the heavy chain CDR1 comprises X1, Y, Y, M, and X2, and wherein X1 is S or D and X2 is H or S.

Embodiment 16. The antibody, or antigen binding portion thereof, of Embodiment 13 or 14, wherein the heavy chain CDR1 comprises R, X1, Y, W, and X2, and wherein X1 is H or Y and X2 is N or S.

Embodiment 17. The antibody, or antigen binding portion thereof, of any one of Embodiments 13 to 16, wherein the heavy chain CDR2 comprises X1, I, X2, X3, X4, G, X5, X6, X7, X8, Y, X9, X10, X11, X12, X13, and X14, and wherein X1 is S, Y, I, or F, X2 is Y, H, N, or S, X3 is Y, P, G, T, or S, X4 is S, T, R, or G, X5 is F, S, or D, X6 is S, T, or I, X7 is I or none, X8 is Y, N, or I, X9 is N, Q, S, or A, X10 is P, S, Q, or D, X11 is S or K, X12 is L, F, or V, X13 is K or Q, and X14 is S or G.

Embodiment 18. The antibody, or antigen binding portion thereof, of any one of Embodiments 13 to 17, wherein the heavy chain CDR2 comprises Y, I, H, Y, X1, G, S, T, N, Y, N, X2, S, L, K, and S, and wherein X1 is S or T and X2 is S or P.

Embodiment 19. The antibody, or antigen binding portion thereof, of any one of Embodiments 13 to 17, wherein the heavy chain CDR2 comprises F, I, S, X1, X2, G, S, X3, I, Y, Y, A, D, S, V, K, and G, and wherein X1 is G, T or S, X2 is G or S, and X3 is T or I.

Embodiment 20. The antibody, or antigen binding portion thereof, of any one of Embodiments 13 to 17, wherein the heavy chain CDR2 comprises I, I, N, P, R, G, D, S, I, I, Y, A, Q, K, F, Q, and G.

Embodiment 21. The antibody, or antigen binding portion thereof, of any one of Embodiments 13 to 20, wherein the light chain CDR1 comprises SEQ ID NO: 64 or SEQ ID NO: 65.

Embodiment 22. The antibody, or antigen binding portion thereof, of any one of Embodiments 13 to 21, wherein the light chain CDR2 comprises SEQ ID NO: 66 or SEQ ID NO: 67.

Embodiment 23. The antibody, or antigen binding portion thereof, of any one of Embodiments 13 to 22, wherein the light chain CDR3 comprises SEQ ID NO: 68, SEQ ID NO: 69, SEQ ID NO: 70, or SEQ ID NO: 71.

Embodiment 24. The antibody, or antigen binding portion thereof, of any one of the preceding Embodiments, wherein the antibody, or antigen binding portion thereof, comprises heavy chain CDR1, CDR2, and CDR3 and light chain CDR1, CDR2, and CDR3, wherein (a) the heavy chain CDR1 is selected from the group consisting of SEQ ID NO: 41, SEQ ID NO: 42; SEQ ID NO: 43; SEQ ID NO: 44; and SEQ ID NO: 45;

(b) the heavy chain CDR2 is selected from the group consisting of SEQ ID NO: 46, SEQ ID NO: 47; SEQ ID NO: 48; SEQ ID NO: 49; SEQ ID NO: 50; SEQ ID NO: 51; SEQ ID NO: 52; SEQ ID NO: 122; SEQ ID NO: 123; SEQ ID NO: 124 and SEQ ID NO: 125;

(c) the heavy chain CDR3 is selected from the group consisting of SEQ ID NO: 53, SEQ ID NO: 54; SEQ ID NO: 55; SEQ ID NO: 56; SEQ ID NO: 57; SEQ ID NO: 58; SEQ ID NO: 59; SEQ ID NO: 126; SEQ ID NO: 127; SEQ ID NO:128 and SEQ ID NO: 129;

(d) the light chain CDR1 comprises SEQ ID NO: 64 or SEQ ID NO: 65;

(e) the light chain CDR2 comprises SEQ ID NO: 66 or SEQ ID NO: 67; and (f) the light chain CDR3 comprises SEQ ID NO: 68, SEQ ID NO: 69, SEQ ID NO: 70, or SEQ ID NO: 71.

Embodiment 25. An isolated antibody, or antigen binding portion thereof, which binds to human TIM3, comprising:

(a1) the heavy chain variable region CDR1, CDR2, and CDR3 comprises SEQ ID NOs: 41, 46, 53, respectively, and the light chain variable region CDR1, CDR2, and CDR3 comprises SEQ ID NOs: 64, 66, 68, respectively;

(a2) the heavy chain variable region CDR1, CDR2, and CDR3 comprises SEQ ID NOs: 41, 122, 53, respectively, and the light chain variable region CDR1, CDR2, and CDR3 comprises SEQ ID NOs: 64, 66, 68, respectively;

(a3) the heavy chain variable region CDR1, CDR2, and CDR3 comprises SEQ ID NOs: 41, 123, 53, respectively, and the light chain variable region CDR1, CDR2, and CDR3 comprises SEQ ID NOs: 64, 66, 68, respectively;

(a4) the heavy chain variable region CDR1, CDR2, and CDR3 comprises SEQ ID NOs: 41, 124, 53, respectively, and the light chain variable region CDR1, CDR2, and CDR3 comprises SEQ ID NOs: 64, 66, 68, respectively;

(a5) the heavy chain variable region CDR1, CDR2, and CDR3 comprises SEQ ID NOs: 41, 46, 126, respectively, and the light chain variable region CDR1, CDR2, and CDR3 comprises SEQ ID NOs: 64, 66, 68, respectively;

(a6) the heavy chain variable region CDR1, CDR2, and CDR3 comprises SEQ ID NOs: 41, 46, 127, respectively, and the light chain variable region CDR1, CDR2, and CDR3 comprises SEQ ID NOs: 64, 66, 68, respectively;

(a7) the heavy chain variable region CDR1, CDR2, and CDR3 comprises SEQ ID NOs: 41, 46, 128, respectively, and the light chain variable region CDR1, CDR2, and CDR3 comprises SEQ ID NOs: 64, 66, 68, respectively;

(a8) the heavy chain variable region CDR1, CDR2, and CDR3 comprises SEQ ID NOs: 41, 46, 129, respectively, and the light chain variable region CDR1, CDR2, and CDR3 comprises SEQ ID NOs: 64, 66, 68, respectively;

(a9) the heavy chain variable region CDR1, CDR2, and CDR3 comprises SEQ ID NOs: 41, 122, 128, respectively, and the light chain variable region CDR1, CDR2, and CDR3 comprises SEQ ID NOs: 64, 66, 68, respectively;

(a10) the heavy chain variable region CDR1, CDR2, and CDR3 comprises SEQ ID NOs: 41, 122, 126, respectively, and the light chain variable region CDR1, CDR2, and CDR3 comprises SEQ ID NOs: 64, 66, 68, respectively;

(b1) the heavy chain variable region CDR1, CDR2, and CDR3 comprises SEQ ID NOs: 42, 47, 54, respectively, and the light chain variable region CDR1, CDR2, and CDR3 comprises SEQ ID NOs: 64, 66, 69, respectively;

(b2) the heavy chain variable region CDR1, CDR2, and CDR3 comprises SEQ ID NOs: 42, 125, 54, respectively, and the light chain variable region CDR1, CDR2, and CDR3 comprises SEQ ID NOs: 64, 66, 69, respectively;

(c) heavy chain CDR1, CDR2, and CDR3 sequences comprising SEQ ID NOs: 43, 48, and 55, respectively, and/or light chain CDR1, CDR2, and CDR3 sequences comprising SEQ ID NOs: 64, 66, and 69, respectively;

(d) heavy chain CDR1, CDR2, and CDR3 sequences comprising SEQ ID NOs: 44, 49, and 56, respectively, and/or light chain CDR1, CDR2, and CDR3 sequences comprising SEQ ID NOs: 64, 66, and 68, respectively;

(e) heavy chain CDR1, CDR2, and CDR3 sequences comprising SEQ ID NOs: 45, 50, and 57, respectively, and/or light chain CDR1, CDR2, and CDR3 sequences comprising SEQ ID NOs: 64, 66, and 69, respectively;

(f) heavy chain CDR1, CDR2, and CDR3 sequences comprising SEQ ID NOs: 45, 50, and 57, respectively, and/or light chain CDR1, CDR2, and CDR3 sequences comprising SEQ ID NOs: 64, 66, and 71, respectively;

(g1) heavy chain CDR1, CDR2, and CDR3 sequences comprising SEQ ID NOs: 45, 50, and 57, respectively, and/or light chain CDR1, CDR2, and CDR3 sequences comprising SEQ ID NOs: 65, 67, and 70, respectively;

(g2) the heavy chain variable region CDR1, CDR2, and CDR3 comprises SEQ ID NOs: 45, 50, 57, respectively, and the light chain variable region CDR1, CDR2, and CDR3 comprises SEQ ID NOs: 64, 66, 71, respectively;

(g3) the heavy chain variable region CDR1, CDR2, and CDR3 comprises SEQ ID NOs: 45, 50, 57, respectively, and the light chain variable region CDR1, CDR2, and CDR3 comprises SEQ ID NOs: 64, 66, 69, respectively;

(h) heavy chain CDR1, CDR2, and CDR3 sequences comprising SEQ ID NOs: 45, 51, and 58, respectively, and/or light chain CDR1, CDR2, and CDR3 sequences comprising SEQ ID NOs: 64, 66, and 68, respectively;

(i) heavy chain CDR1, CDR2, and CDR3 sequences comprising SEQ ID NOs: 45, 52, and 59, respectively, and/or light chain CDR1, CDR2, and CDR3 sequences comprising SEQ ID NOs: 64, 66, and 69, respectively.

Embodiment 26. The antibody, or antigen binding portion thereof, of Embodiment 25, wherein the antibody comprises heavy chain CDR1, CDR2, and CDR3 sequences comprising SEQ ID NOs: 41, 46, and 53, respectively, and/or light chain CDR1, CDR2, and CDR3 sequences comprising SEQ ID NOs: 64, 66, and 68, respectively.

Embodiment 27. The antibody, or antigen binding portion thereof, of Embodiment 25, wherein the antibody comprises heavy chain CDR1, CDR2, and CDR3 sequences comprising SEQ ID NOs: 42, 47, and 54, respectively, and/or light chain CDR1, CDR2, and CDR3 sequences comprising SEQ ID NOs: 64, 66, and 69, respectively.

Embodiment 28. The antibody, or antigen binding portion thereof, of Embodiment 25, wherein the antibody comprises heavy chain CDR1, CDR2, and CDR3 sequences comprising SEQ ID NOs: 43, 48, and 55, respectively, and/or light chain CDR1, CDR2, and CDR3 sequences comprising SEQ ID NOs: 64, 66, and 69, respectively.

Embodiment 29. The antibody, or antigen binding portion thereof, of Embodiment 25, wherein the antibody comprises heavy chain CDR1, CDR2, and CDR3 sequences comprising SEQ ID NOs: 44, 49, and 56, respectively, and/or light chain CDR1, CDR2, and CDR3 sequences comprising SEQ ID NOs: 64, 66, and 68, respectively.

Embodiment 30. The antibody, or antigen binding portion thereof, of Embodiment 25, wherein the antibody comprises heavy chain CDR1, CDR2, and CDR3 sequences comprising SEQ ID NOs: 45, 50, and 57, respectively, and/or light chain CDR1, CDR2, and CDR3 sequences comprising SEQ ID NOs: 64, 66, and 69, respectively.

Embodiment 31. The antibody, or antigen binding portion thereof, of Embodiment 25, wherein the antibody comprises heavy chain CDR1, CDR2, and CDR3 sequences comprising SEQ ID NOs: 45, 50, and 57, respectively, and/or light chain CDR1, CDR2, and CDR3 sequences comprising SEQ ID NOs: 64, 66, and 71, respectively.

Embodiment 32. The antibody, or antigen binding portion thereof, of Embodiment 25, wherein the antibody comprises heavy chain CDR1, CDR2, and CDR3 sequences comprising SEQ ID NOs: 45, 50, and 57, respectively, and/or light chain CDR1, CDR2, and CDR3 sequences comprising SEQ ID NOs: 65, 67, and 70, respectively.

Embodiment 33. The antibody, or antigen binding portion thereof, of Embodiment 25, wherein the antibody comprises heavy chain CDR1, CDR2, and CDR3 sequences comprising SEQ ID NOs: 45, 51, and 58, respectively, and/or light chain CDR1, CDR2, and CDR3 sequences comprising SEQ ID NOs: 64, 66, and 68, respectively.

Embodiment 34. The antibody, or antigen binding portion thereof, of Embodiment 25, wherein the antibody comprises heavy chain CDR1, CDR2, and CDR3 sequences comprising SEQ ID NOs: 45, 52, and 59, respectively, and/or light chain CDR1, CDR2, and CDR3 sequences comprising SEQ ID NOs: 64, 66, and 69, respectively.

Embodiment 35. An isolated antibody, or antigen binding portion thereof, which binds to human TIM3 and comprises heavy and light chain variable regions, wherein the heavy chain variable region comprises an amino acid sequence which is at least about 80%, at least about 85%, at least about 90%, at least about 95%, at least about 96%, at least about 97%, at least about 98%, at least about 99%, or about 100% identical to the amino acid sequence selected from the group consisting of SEQ ID NOs: 34, 35, 36, 37, 38, 39, 40, 112, 113, 114, 115, 116, 117, 118, 119, 120, 121, and 364.

Embodiment 36. An isolated antibody, or antigen binding portion thereof, which binds to human TIM3 and comprises heavy and light chain variable regions, wherein the light chain variable region comprises an amino acid sequence which is at least about 80%, at least about 85%, at least about 90%, at least about 95%, at least about 96%, at least about 97%, at least about 98%, at least about 99%, or about 100% identical to the amino acid sequence selected from the group consisting of SEQ ID NOs: 60, 61, 62, and 63.

Embodiment 37. An isolated antibody, or antigen binding portion thereof, which binds to human TIM3 and cross-competes for binding to human TIM3 with a reference antibody comprising a VH and a VL, wherein the VH and the VL are selected from the group consisting of:

(a) a VH comprising the amino acid sequence set forth in SEQ ID NO: 34 and a VL comprising the amino acid sequence set forth in SEQ ID NO: 60;

(b) a VH comprising the amino acid sequence set forth in SEQ ID NO: 35 and a VL comprising the amino acid sequence set forth in SEQ ID NO: 61;

(c) a VH comprising the amino acid sequence set forth in SEQ ID NO: 36 and a VL comprising the amino acid sequence set forth in SEQ ID NO: 61;

(d) a VH comprising the amino acid sequence set forth in SEQ ID NO: 37 and a VL comprising the amino acid sequence set forth in SEQ ID NO: 60;

(e) a VH comprising the amino acid sequence set forth in SEQ ID NO: 38 and a VL comprising the amino acid sequence set forth in SEQ ID NO: 61;

(f) a VH comprising the amino acid sequence set forth in SEQ ID NO: 38 and a VL comprising the amino acid sequence set forth in SEQ ID NO: 62;

(g) a VH comprising the amino acid sequence set forth in SEQ ID NO: 38 and a VL comprising the amino acid sequence set forth in SEQ ID NO: 63;

(h) a VH comprising the amino acid sequence set forth in SEQ ID NO: 39 and a VL comprising the amino acid sequence set forth in SEQ ID NO: 60;

(i) a VH comprising the amino acid sequence set forth in SEQ ID NO: 40 and a VL comprising the amino acid sequence set forth in SEQ ID NO: 61.

(j) a VH comprising the amino acid sequence set forth in SEQ ID NOs: 121 and a VL comprising the amino acid sequence set forth in 63, respectively;

(k) a VH comprising the amino acid sequence set forth in SEQ ID NOs: 120 and a VL comprising the amino acid sequence set forth in 61, respectively;

(l) a VH comprising the amino acid sequence set forth in SEQ ID NOs: 112 and a VL comprising the amino acid sequence set forth in 60, respectively;

(m) a VH comprising the amino acid sequence set forth in SEQ ID NOs: 113 and a VL comprising the amino acid sequence set forth in 60, respectively;

(n) a VH comprising the amino acid sequence set forth in SEQ ID NOs: 114 and a VL comprising the amino acid sequence set forth in 60, respectively;

(o) a VH comprising the amino acid sequence set forth in SEQ ID NOs: 115 and a VL comprising the amino acid sequence set forth in 60, respectively;

(p) a VH comprising the amino acid sequence set forth in SEQ ID NOs: 116 and a VL comprising the amino acid sequence set forth in 60, respectively;

(q) a VH comprising the amino acid sequence set forth in SEQ ID NOs: 117 and a VL comprising the amino acid sequence set forth in 60, respectively;

(r) a VH comprising the amino acid sequence set forth in SEQ ID NOs: 118 and a VL comprising the amino acid sequence set forth in 60, respectively;

(s) a VH comprising the amino acid sequence set forth in SEQ ID NOs: 119 and a VL comprising the amino acid sequence set forth in 60, respectively; and (t) a VH comprising the amino acid sequence set forth in SEQ ID NOs: 364 and a VL comprising the amino acid sequence set forth in 60, respectively.

Embodiment 38. The antibody, or antigen binding portion thereof, of Embodiment 37, which binds to TIM3 at the same epitope as the reference antibody, as determined, e.g., by one or methods provided herein.

Embodiment 39. The antibody, or antigen binding portion thereof, of Embodiment 37 or 38, which comprises a VH and a VL, selected from the group consisting of:

(a) a VH comprising the amino acid sequence set forth in SEQ ID NO: 34 and a VL comprising the amino acid sequence set forth in SEQ ID NO: 60;

(b) a VH comprising the amino acid sequence set forth in SEQ ID NO: 35 and a VL comprising the amino acid sequence set forth in SEQ ID NO: 61;
(c) a VH comprising the amino acid sequence set forth in SEQ ID NO: 36 and a VL comprising the amino acid sequence set forth in SEQ ID NO: 61;
(d) a VH comprising the amino acid sequence set forth in SEQ ID NO: 37 and a VL comprising the amino acid sequence set forth in SEQ ID NO: 60;
(e) a VH comprising the amino acid sequence set forth in SEQ ID NO: 38 and a VL comprising the amino acid sequence set forth in SEQ ID NO: 61;
(f) a VH comprising the amino acid sequence set forth in SEQ ID NO: 38 and a VL comprising the amino acid sequence set forth in SEQ ID NO: 62;
(g) a VH comprising the amino acid sequence set forth in SEQ ID NO: 38 and a VL comprising the amino acid sequence set forth in SEQ ID NO: 63;
(h) a VH comprising the amino acid sequence set forth in SEQ ID NO: 39 and a VL comprising the amino acid sequence set forth in SEQ ID NO: 60;
(i) a VH comprising the amino acid sequence set forth in SEQ ID NO: 40 and a VL comprising the amino acid sequence set forth in SEQ ID NO: 61;
(j) a VH comprising the amino acid sequence set forth in SEQ ID NOs: 121 and a VL comprising the amino acid sequence set forth in 63, respectively;
(k) a VH comprising the amino acid sequence set forth in SEQ ID NOs: 120 and a VL comprising the amino acid sequence set forth in 61, respectively;
(l) a VH comprising the amino acid sequence set forth in SEQ ID NOs: 112 and a VL comprising the amino acid sequence set forth in 60, respectively;
(m) a VH comprising the amino acid sequence set forth in SEQ ID NOs: 113 and a VL comprising the amino acid sequence set forth in 60, respectively;
(n) a VH comprising the amino acid sequence set forth in SEQ ID NOs: 114 and a VL comprising the amino acid sequence set forth in 60, respectively;
(o) a VH comprising the amino acid sequence set forth in SEQ ID NOs: 115 and a VL comprising the amino acid sequence set forth in 60, respectively;
(p) a VH comprising the amino acid sequence set forth in SEQ ID NOs: 116 and a VL comprising the amino acid sequence set forth in 60, respectively;
(q) a VH comprising the amino acid sequence set forth in SEQ ID NOs: 117 and a VL comprising the amino acid sequence set forth in 60, respectively;
(r) a VH comprising the amino acid sequence set forth in SEQ ID NOs: 118 and a VL comprising the amino acid sequence set forth in 60, respectively;
(s) a VH comprising the amino acid sequence set forth in SEQ ID NOs: 119 and a VL comprising the amino acid sequence set forth in 60, respectively; and
(t) a VH comprising the amino acid sequence set forth in SEQ ID NOs: 364 and a VL comprising the amino acid sequence set forth in 60, respectively.

Embodiment 40. The antibody, or antigen binding portion thereof, of Embodiment 37 or 38, which comprises a VH comprising an amino acid sequence selected from the group consisting of SEQ ID NO: 34, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, and SEQ ID NO: 364 and a VL comprising the amino acid sequence set forth in SEQ ID NO: 60.

Embodiment 41. The antibody, or antigen binding portion thereof, of Embodiment 37 or 38, which comprises a VH comprising the amino acid sequence set forth in SEQ ID NO: 35 or SEQ ID NO: 120 and a VL comprising the amino acid sequence set forth in SEQ ID NO: 61.

Embodiment 42. The antibody, or antigen binding portion thereof, of Embodiment 37 or 38, which comprises a VH comprising the amino acid sequence set forth in SEQ ID NO: 36 and a VL comprising the amino acid sequence set forth in SEQ ID NO: 61.

Embodiment 43. The antibody, or antigen binding portion thereof, of Embodiment 37 or 38, which comprises a VH comprising the amino acid sequence set forth in SEQ ID NO: 37 and a VL comprising the amino acid sequence set forth in SEQ ID NO: 60.

Embodiment 44. The antibody, or antigen binding portion thereof, of Embodiment 37 or 38, which comprises a VH comprising the amino acid sequence set forth in SEQ ID NO: 38 or SEQ ID NO: 121 and a VL comprising the amino acid sequence set forth in SEQ ID NO: 61, SEQ ID NO: 63, or SEQ ID NO: 62.

Embodiment 45. The antibody, or antigen binding portion thereof, of Embodiment 37 or 38, which comprises a VH comprising the amino acid sequence set forth in SEQ ID NO: 39 and a VL comprising the amino acid sequence set forth in SEQ ID NO: 60.

Embodiment 46. The antibody, or antigen binding portion thereof, of Embodiment 37 or 38, which comprises a VH comprising the amino acid sequence set forth in SEQ ID NO: 40 and a VL comprising the amino acid sequence set forth in SEQ ID NO: 61.

Embodiment 47. The antibody, or antigen binding portion thereof, of any one of the preceding Embodiments, wherein the antibody is selected from the group consisting of an IgG1, an IgG2, an IgG3, an IgG4 or a variant thereof.

Embodiment 48. The antibody, or antigen binding portion thereof, of Embodiment 47, wherein the antibody is an IgG1 antibody.

Embodiment 49. The antibody, or antigen binding portion thereof, of Embodiment 47, wherein the antibody comprises an effectorless IgG1 Fc.

Embodiment 50. The antibody, or antigen binding portion thereof, of Embodiment 49, wherein the antibody, or antigen binding portion thereof, comprises an effectorless IgG1 Fc that comprises the following mutations: L234A, L235E, G237A, and optionally A330S and P331S.

Embodiment 51. The antibody, or antigen binding portion thereof, of any of the preceding Embodiments, comprising a heavy chain constant region comprising an amino acid sequence selected from the group consisting of SEQ ID NOs: 263-266.

Embodiment 52. The antibody, or antigen binding portion thereof, of any one of Embodiments 1-51, wherein the antibody, or antigen binding portion thereof, is a human or humanized antibody.

Embodiment 53. The antibody of any one of Embodiments 1-52, wherein the antibody comprises:
(a1) heavy and light chain sequences comprising SEQ ID NOs: 301 (or 302) and 29, respectively;
(a2) heavy and light chain sequences comprising SEQ ID NOs: 1 (or 8) and 29, respectively;
(a3) heavy and light chain sequences comprising SEQ ID NOs: 15 (or 22) and 29, respectively;
(a4) heavy and light chain sequences comprising SEQ ID NOs: 303 (or 304) and 29, respectively;
(a5) heavy and light chain sequences comprising SEQ ID NOs: 72 (or 82) and 29, respectively;
(a6) heavy and light chain sequences comprising SEQ ID NOs: 92 (or 102) and 29, respectively;

(a7) heavy and light chain sequences comprising SEQ ID NOs: 305 (or 306) and 29, respectively;
(a8) heavy and light chain sequences comprising SEQ ID NOs: 73 (or 83) and 29, respectively;
(a9) heavy and light chain sequences comprising SEQ ID NOs: 93 (or 103) and 29, respectively;
(a10) heavy and light chain sequences comprising SEQ ID NOs: 307 (or 308) and 29, respectively;
(a11) heavy and light chain sequences comprising SEQ ID NOs: 74 (or 84) and 29, respectively;
(a12) heavy and light chain sequences comprising SEQ ID NOs: 94 (or 104) and 29, respectively;
(a13) heavy and light chain sequences comprising SEQ ID NOs: 309 (or 310) and 29, respectively;
(a14) heavy and light chain sequences comprising SEQ ID NOs: 75 (or 85) and 29, respectively;
(a15) heavy and light chain sequences comprising SEQ ID NOs: 95 (or 105) and 29, respectively;
(a16) heavy and light chain sequences comprising SEQ ID NOs: 311 (or 312) and 29, respectively;
(a17) heavy and light chain sequences comprising SEQ ID NOs: 76 (or 86) and 29, respectively;
(a18) heavy and light chain sequences comprising SEQ ID NOs: 96 (or 106) and 29, respectively;
(a19) heavy and light chain sequences comprising SEQ ID NOs: 313 (or 314) and 29, respectively;
(a20) heavy and light chain sequences comprising SEQ ID NOs: 77 (or 87) and 29, respectively;
(a21) heavy and light chain sequences comprising SEQ ID NOs: 97 (or 107) and 29, respectively;
(a22) heavy and light chain sequences comprising SEQ ID NOs: 315 (or 316) and 29, respectively;
(a23) heavy and light chain sequences comprising SEQ ID NOs: 78 (or 88) and 29, respectively;
(a24) heavy and light chain sequences comprising SEQ ID NOs: 98 (or 108) and 29, respectively;
(a25) heavy and light chain sequences comprising SEQ ID NOs: 317 (or 318) and 29, respectively;
(a26) heavy and light chain sequences comprising SEQ ID NOs: 79 (or 89) and 29, respectively;
(a27) heavy and light chain sequences comprising SEQ ID NOs: 99 (or 109) and 29, respectively;
(a28) heavy and light chain sequences comprising SEQ ID NOs: 319 (or 320) and 29, respectively;
(a29) heavy and light chain sequences comprising SEQ ID NOs: 349 (or 350) and 29, respectively;
(a30) heavy and light chain sequences comprising SEQ ID NOs: 351 (or 352) and 29, respectively;
(a31) heavy and light chain sequences comprising SEQ ID NOs: 353 (or 354) and 29, respectively;
(b1) heavy and light chain sequences comprising SEQ ID NOs: 321 (or 322) and 30, respectively;
(b2) heavy and light chain sequences comprising SEQ ID NOs: 2 (or 9) and 30, respectively;
(b3) heavy and light chain sequences comprising SEQ ID NOs: 16 (or 23) and 30, respectively;
(b4) heavy and light chain sequences comprising SEQ ID NOs: 323 (or 324) and 30, respectively;
(b5) heavy and light chain sequences comprising SEQ ID NOs: 80 (or 90) and 30, respectively;
(b6) heavy and light chain sequences comprising SEQ ID NOs: 100 (or 110) and 30, respectively;
(b7) heavy and light chain sequences comprising SEQ ID NOs: 325 (or 326) and 30, respectively;
(c1) heavy and light chain sequences comprising SEQ ID NOs: 327 (or 328) and 30, respectively;
(c2) heavy and light chain sequences comprising SEQ ID NOs: 3 (or 10) and 30, respectively;
(c3) heavy and light chain sequences comprising SEQ ID NOs: 17 (or 24) and 30, respectively;
(c4) heavy and light chain sequences comprising SEQ ID NOs: 329 (or 330) and 30, respectively;
(d1) heavy and light chain sequences comprising SEQ ID NOs: 331 (or 332) and 29, respectively;
(d2) heavy and light chain sequences comprising SEQ ID NOs: 4 (or 11) and 29, respectively;
(d3) heavy and light chain sequences comprising SEQ ID NOs: 18 (or 25) and 29, respectively;
(d4) heavy and light chain sequences comprising SEQ ID NOs: 333 (or 334) and 29, respectively;
(e1.1) heavy and light chain sequences comprising SEQ ID NOs: 335 (or 336) and 32, respectively;
(e1.2) heavy and light chain sequences comprising SEQ ID NOs: 335 (or 336) and 33, respectively;
(e1.3) heavy and light chain sequences comprising SEQ ID NOs: 335 (or 336) and 31, respectively;
(e2) heavy and light chain sequences comprising SEQ ID NOs: 5 (or 12) and 33, respectively;
(e3) heavy and light chain sequences comprising SEQ ID NOs: 19 (or 26) and 33, respectively;
(e4) heavy and light chain sequences comprising SEQ ID NOs: 337 (or 338) and 33, respectively;
(e5) heavy and light chain sequences comprising SEQ ID NOs: 81 (or 91) and 33, respectively;
(e6) heavy and light chain sequences comprising SEQ ID NOs: 101 (or 111) and 33, respectively;
(e7) heavy and light chain sequences comprising SEQ ID NOs: 339 (or 340) and 33, respectively;
(f1) heavy and light chain sequences comprising SEQ ID NOs: 341 (or 342) and 29, respectively;
(f2) heavy and light chain sequences comprising SEQ ID NOs: 6 (or 13) and 29, respectively;
(f3) heavy and light chain sequences comprising SEQ ID NOs: 20 (or 27) and 29, respectively;
(f4) heavy and light chain sequences comprising SEQ ID NOs: 343 (or 344) and 29, respectively;
(g1) heavy and light chain sequences comprising SEQ ID NOs: 345 (or 346) and 29, respectively;
(g2) heavy and light chain sequences comprising SEQ ID NOs: 7 (or 43) and 30, respectively;
(g3) heavy and light chain sequences comprising SEQ ID NOs: 21 (or 28) and 30, respectively; or
(g4) heavy and light chain sequences comprising SEQ ID NOs: 347 (or 348) and 30, respectively; wherein the antibody specifically binds to human TIM3.

Embodiment 54. The antibody, or antigen binding portion thereof, of any of Embodiments 1-53, wherein the antibody, or antigen binding portion thereof, has one or more of the following properties:
(1) binding to soluble human TIM3, e.g., with a KD of 10 nM or less (e.g., 0.01 nM to 10 nM), e.g., as measured by Biacore;
(2) binding to soluble cynomolgus TIM3, e.g., with a KD of 100 nM or less (e.g., 0.01 nM to 100 nM), e.g., as measured by Biacore;
(3) binding to membrane bound human TIM3, e.g., with an EC50 of 1 ug/mL or less (e.g., 0.01 ug/mL to 1 ug/mL), e.g., as measured by flow cytometry;
(4) binding to membrane bound human TIM3, e.g., with a KD of 1 nM or less (e.g., 0.01 nM to 10 nM), e.g., as measured by Scatchard analysis;

(5) binding to membrane bound cynomolgus TIM3, e.g., with an EC50 of 20 ug/mL or less (e.g., 0.01 ug/mL to 20 ug/mL), e.g., as measured by flow cytometry;
(6) binding to membrane bound cynomolgus TIM3, e.g., with a KD of 1 nM or less (e.g., 0.01 nM to 10 nM), e.g., as measured by Scatchard analysis;
(7) inducing or enhancing T cell activation (e.g., by blocking or reducing the inhibitory effect of TIM3), as evidenced by (i) increased IFN-γ production in TIM3-expressing T cells (e.g., Th1 cells or TILs) and/or (ii) enhanced proliferation of TIM3-expressing T cells (e.g., Th1 cells or TILs);
(8) stimulating T cell proliferation in a mixed lymphocyte reaction (MLR) assay;
(9) inhibiting the binding of phosphatidylserine to TIM3, e.g., as measured by PS-hTIM3 "in-tandem" blocking assay;
(10) not internalizing or downregulating cell surface TIM3 when binding to TIM3 on cells;
(11) binding to one of the following regions of human TIM3 extracellular domain (SEQ ID NO: 290): (a) CPVFECG (SEQ ID NO: 296); (b) RIQIPGIMND (SEQ ID NO: 298); (c) CPVFECG and RIQIPGIMND (SEQ ID NOs: 296 and 298, respectively); and (d) WTSRYWLNGDFR (SEQ ID NO: 297);
(12) having reduced binding to human TIM3 in which one or more of amino acids L48, C58, P59, V60, F61, E62, C63, G64, W78, S80, R81, W83, L84, G86, D87, R89, D104, R111, Q113, G116, M118 and D120 (as numbered in SEQ ID NO: 286 (FIG. 30)) is substituted with another amino acid relative to binding to wildtype human TIM3;
(13) competing in either direction or both directions for binding to human TIM3 with an antibody comprising VH and VL domains of any one of 13A3, 3G4, 17C3, 17C8, 9F6, 8B9, 8C4, or TIM3.7, TIM3.8, TIM3.10, TIM3.11, TIM3.12, TIM3.13, TIM3.14, TIM3.15, TIM3.16, TIM3.17, and TIM3.18;
(14) binding to human TIM3 regions 49VPVCWGK-GACPVFE62 (SEQ ID NO: 367) and 111RIQIPGIMNDEKFNLKL127 (SEQ ID NO: 368) as determined by HDX-MS (15) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (e.g., described in the Examples; numbering per SEQ ID NO: 286 (FIG. 30)); and/or
(16) (a) having reduced binding to human TIM3 in which 1, 2, 3, 4, 5, 6, 7, 8 or 9 of amino acids C58, P59, F61, E62, C63, R111, D120, and optionally D104 and Q113 (numbering per SEQ ID NO: 286 (FIG. 30)) are substituted with another amino acid relative to binding to wildtype human TIM3; (b) binding to 49VPVCWGK-GACPVFE62 (SEQ ID NO: 367), 111RIQIPGIMNDEKFNLKL127 (SEQ ID NO: 368) and 119NDEKFNLKL127 (SEQ ID NO: 373), as determined by HDX-MS, as described in the Examples; and/or (c) competing with or cross-blocking with the binding to human TIM3 of 13A3 or TIM3.18.IgG1.3.

Embodiment 55. A bispecific molecule comprising the antibody of any one of the preceding Embodiments linked to a molecule having a second binding specificity.

Embodiment 56. A nucleic acid encoding the heavy and/or light chain variable region of the antibody, or antigen binding portion thereof, of any one of Embodiments 1-54.

Embodiment 57. An expression vector comprising the nucleic acid molecule of Embodiment 56.

Embodiment 58. A cell transformed with an expression vector of Embodiment 57.

Embodiment 59. An immunoconjugate comprising the antibody according to any one of Embodiments 1-54, linked to an agent.

Embodiment 60. A composition comprising the antibody, or antigen binding portion thereof, bispecific molecule or immunoconjugate, of any one of Embodiments 1-55 and 59, and a carrier.

Embodiment 61. A kit comprising the antibody, or antigen binding portion thereof, or bispecific molecule, or immunoconjugate of any one of Embodiments 1-55 and 59 and instructions for use.

Embodiment 62. A method of preparing an anti-TIM3 antibody, or antigen binding portion thereof, comprising expressing the antibody, or antigen binding portion thereof, in the cell of Embodiment 58 and isolating the antibody, or antigen binding portion thereof, from the cell.

Embodiment 63. A method of stimulating an antigen-specific T cell response comprising contacting the T cell with the antibody, or antigen binding portion thereof, bispecific molecule or immunoconjugate, of any one of Embodiments 1-55 and 59 such that an antigen-specific T cell response is stimulated.

Embodiment 64. A method of activating or co-stimulating an effector T cell, comprising contacting an effector T cell with an anti-TIM3 antibody, or antigen binding portion thereof, bispecific molecule or immunoconjugate, of any one of Embodiments 1-55 and 59 and CD3, wherein the effector T cell is activated or co-stimulated.

Embodiment 65. A method of increasing IFN-γ production in a T cell comprising contacting the T cell with an effective amount of the antibody, or antigen binding portion thereof, bispecific molecule or immunoconjugate, of any one of Embodiments 1-55 and 59.

Embodiment 66. A method of increasing T cell proliferation comprising contacting the cell with an effective amount of the antibody, or antigen binding portion thereof, bispecific molecule or immunoconjugate, of any one of Embodiments 1-55 and 59.

Embodiment 67. A method of increasing IFN-γ production in T cells in a subject comprising administering an effective amount of the antibody, or antigen binding portion thereof, bispecific molecule or immunoconjugate, of any one of Embodiments 1-55 and 59, to increase IFN-γ production from the T cells.

Embodiment 68. A method of stimulating TIL activity in a subject, comprising administering to a subject a therapeutically effective amount of an anti-TIM3 antibody of any one of Embodiments 1-54.

Embodiment 69. A method of stimulating an immune response in a subject comprising administering the antibody, or antigen binding portion thereof, bispecific molecule or immunoconjugate, of any one of Embodiments 1-55 and 59 to the subject such that an immune response in the subject is stimulated.

Embodiment 70. The method of Embodiment 69, wherein the subject has a tumor and an immune response against the tumor is stimulated.

Embodiment 71. A method for inhibiting the growth of tumors or reducing the size of tumors in a subject comprising administering to the subject the antibody, or antigen binding portion thereof, bispecific molecule or immunoconjugate, of any one of Embodiments 1-55 and 59, such that growth of the tumor is inhibited in the subject.

Embodiment 72. A method of treating cancer comprising administering to a subject in need thereof a therapeutically effective amount of the antibody, or antigen binding portion thereof, bispecific molecule or immunoconjugate, of any one of Embodiments 1-55 and 59, to treat the cancer.

Embodiment 73. The method of Embodiment 72, wherein the cancer is selected from the group consisting of: bladder cancer, breast cancer, uterine/cervical cancer, ovarian cancer, prostate cancer, testicular cancer, esophageal cancer, gastrointestinal cancer, pancreatic cancer, colorectal cancer, colon cancer, kidney cancer, head and neck cancer, lung cancer, stomach cancer, germ cell cancer, bone cancer, liver cancer, thyroid cancer, skin cancer, neoplasm of the central nervous system, lymphoma, leukemia, myeloma, sarcoma, and virus-related cancer.

Embodiment 74. The method of Embodiment 72 or 73, wherein the cancer is a metastatic cancer, refractory cancer, or recurrent cancer.

Embodiment 75. The method of any one of Embodiments 67-74, further comprising administering one or more additional therapeutics.

Embodiment 76. The method of Embodiment 75, wherein the additional therapy is an anti-PD-1 antibody, an anti-LAG-3 antibody, an anti-CTLA-4 antibody, an anti-GITR antibody, or an anti-PD-L1 antibody.

Embodiment 77. A method of detecting the presence of T-cell immunoglobulin and mucin-domain containing-3 (TIM3) in a sample comprising contacting the sample with the antibody, or antigen binding portion thereof, of any one of Embodiments 1-54, under conditions that allow for formation of a complex between the antibody, or antigen binding portion thereof, and TIM3, and detecting the formation of a complex.

BRIEF DESCRIPTION OF THE DRAWINGS/FIGURES

FIG. 1A shows the nucleotide sequence (SEQ ID NO: 167) and the amino acid sequence (SEQ ID NO: 34) of the mature heavy chain variable (VH) region of the anti-TIM3 monoclonal antibody 13A3. The CDR1 (SEQ ID NO: 41), CDR2 (SEQ ID NO: 46) and CDR3 (SEQ ID NO: 53) are delineated, and the V, D and J germline derivations are indicated.

FIG. 1B shows the nucleotide sequence (SEQ ID NO: 193) and the amino acid sequence (SEQ ID NO: 60) of the mature light chain variable (VL) region of the anti-TIM3 monoclonal antibody 13A3. The CDR1 (SEQ ID NO: 64), CDR2 (SEQ ID NO: 66) and CDR3 (SEQ ID NO: 68) are delineated, and the V and J germline derivations are indicated.

Figure 17A:
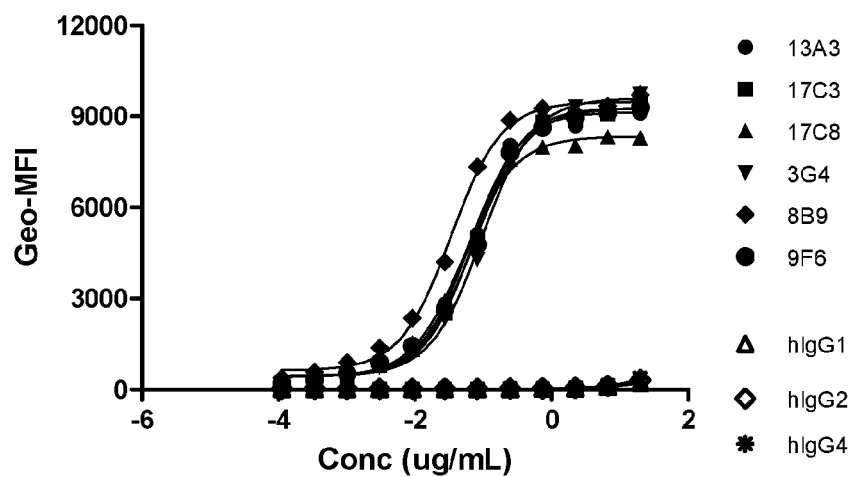

FIG. 1C shows the nucleotide sequence (SEQ ID NO: 167) and the amino acid sequence (SEQ ID NO: 34) of the heavy chain VH region of the anti-TIM3 monoclonal antibody 13A3 with a signal sequence (SEQ ID NOs: 274 and 269, respectively), and the nucleotide sequence (SEQ ID NO: 193) and the amino acid sequence (SEQ ID NO: 60) of the light chain VL region of the anti-TIM3 monoclonal antibody 13A3 with a signal sequence (SEQ ID NOs: 273 and 268, respectively).

FIG. 2A shows the nucleotide sequence (SEQ ID NO: 168) and the amino acid sequence (SEQ ID NO: 35) of the mature heavy chain variable (VH) region of the anti-TIM3 monoclonal antibody 8B9. The CDR1 (SEQ ID NO: 42), CDR2 (SEQ ID NO: 47) and CDR3 (SEQ ID NO: 54) are delineated, and the V, D and J germline derivations are indicated.

FIG. 2B shows the nucleotide sequence (SEQ ID NO: 194) and the amino acid sequence (SEQ ID NO: 61) of the mature light chain variable (VL) region of the anti-TIM3 monoclonal antibody 8B9. The CDR1 (SEQ ID NO: 64), CDR2 (SEQ ID NO: 66) and CDR3 (SEQ ID NO: 69) are delineated, and the V and J germline derivations are indicated.

FIG. 2C shows the nucleotide sequence (SEQ ID NO: 168) and the amino acid sequence (SEQ ID NO: 35) of the heavy chain VH region of the anti-TIM3 monoclonal antibody 8B9 with a signal sequence (SEQ ID NOs: 274 and 269, respectively), and the nucleotide sequence (SEQ ID NO: 194) and the amino acid sequence (SEQ ID NO: 61) of the light chain VL region of the anti-TIM3 monoclonal antibody 8B9 with a signal sequence (SEQ ID NOs: 0.273 and 268, respectively).

FIG. 3A shows the nucleotide sequence (SEQ ID NO: 169) and the amino acid sequence (SEQ ID NO: 36) of the mature heavy chain variable (VH) region of the anti-TIM3 monoclonal antibody 8C4. The CDR1 (SEQ ID NO: 43), CDR2 (SEQ ID NO: 48) and CDR3 (SEQ ID NO: 55) are delineated, and the V, D and J germline derivations are indicated.

FIG. 3B shows the nucleotide sequence (SEQ ID NO: 194) and the amino acid sequence (SEQ ID NO: 61) of the mature light chain variable (VL) region of the anti-TIM3 monoclonal antibody 8C4. The CDR1 (SEQ ID NO: 64), CDR2 (SEQ ID NO: 66) and CDR3 (SEQ ID NO: 69) are delineated, and the V and J germline derivations are indicated.

FIG. 3C shows the nucleotide sequence (SEQ ID NO: 169) and the amino acid sequence (SEQ ID NO: 36) of the heavy chain VH region of the anti-TIM3 monoclonal antibody 8C4 with a signal sequence (SEQ ID NOs: 274 and 269, respectively), and the nucleotide sequence (SEQ ID NO: 194) and the amino acid sequence (SEQ ID NO: 61) of the light chain VL region of the anti-TIM3 monoclonal antibody 8C4 with a signal sequence (SEQ ID NOs: 273 and 268, respectively).

FIG. 4A shows the nucleotide sequence (SEQ ID NO: 170) and the amino acid sequence (SEQ ID NO: 37) of the mature heavy chain variable (VH) region of the anti-TIM3 monoclonal antibody 17C3. The CDR1 (SEQ ID NO: 44), CDR2 (SEQ ID NO: 49) and CDR3 (SEQ ID NO: 56) are delineated, and the V, D and J germline derivations are indicated.

FIG. 4B shows the nucleotide sequence (SEQ ID NO: 193) and the amino acid sequence (SEQ ID NO: 60) of the mature light chain variable (VL) region of the anti-TIM3 monoclonal antibody 17C3. The CDR1 (SEQ ID NO: 64), CDR2 (SEQ ID NO: 66) and CDR3 (SEQ ID NO: 68) are delineated, and the V and J germline derivations are indicated.

FIG. 4C shows the nucleotide sequence (SEQ ID NO: 170) and the amino acid sequence (SEQ ID NO: 37) of the heavy chain VH region of the anti-TIM3 monoclonal antibody 17C3 with a signal sequence (SEQ ID NOs: 272 and 267, respectively), and the nucleotide sequence (SEQ ID NO: 193) and the amino acid sequence (SEQ ID NO: 60) of the light chain VL region of the anti-TIM3 monoclonal antibody 17C3 with a signal sequence (SEQ ID NOs: 273 and 268, respectively).

FIG. 5A shows the nucleotide sequence (SEQ ID NO: 171) and the amino acid sequence (SEQ ID NO: 38) of the mature heavy chain variable (VH) region of the anti-TIM3 monoclonal antibody 9F6. The CDR1 (SEQ ID NO: 45), CDR2 (SEQ ID NO: 50) and CDR3 (SEQ ID NO: 57) are delineated, and the V, D and J germline derivations are indicated.

FIG. 5B shows the nucleotide sequence (SEQ ID NO: 195) and the amino acid sequence (SEQ ID NO: 62) of the mature light chain variable (VL) region of VK1 of the anti-TIM3 monoclonal antibody 9F6. The CDR1 (SEQ ID NO: 65), CDR2 (SEQ ID NO: 67) and CDR3 (SEQ ID NO: 70) are delineated, and the V and J germline derivations are indicated.

FIG. 5C shows the nucleotide sequence (SEQ ID NO: 196) and the amino acid sequence (SEQ ID NO: 63) of the mature light chain variable (VL) region of VK2 of the anti-TIM3 monoclonal antibody 9F6. The CDR1 (SEQ ID NO: 64), CDR2 (SEQ ID NO: 66) and CDR3 (SEQ ID NO: 71) are delineated, and the V and J germline derivations are indicated.

FIG. 5D shows the nucleotide sequence (SEQ ID NO: 194) and the amino acid sequence (SEQ ID NO: 61) of the mature light chain variable (VL) region of VK3 of the anti-TIM3 monoclonal antibody 9F6. The CDR1 (SEQ ID NO: 64), CDR2 (SEQ ID NO: 66) and CDR3 (SEQ ID NO: 69) are delineated, and the V and J germline derivations are indicated.

FIG. 5E shows the nucleotide sequence (SEQ ID NO: 171) and the amino acid sequence (SEQ ID NO: 38) of the heavy chain VH region of the anti-TIM3 monoclonal antibody 9F6 with a signal sequence (SEQ ID NOs: 275 and 270, respectively), and the nucleotide sequences (SEQ ID NO: 195, 196, and 194, respectively) and the amino acid sequences (SEQ ID NO: 62, 63, and 61, respectively) of the light chain VL region of VK1, VK2 and VK3 of the anti-TIM3 monoclonal antibody 9F6 with a signal sequence (SEQ ID NOs: 276 and 271, respectively).

FIG. 6A shows the nucleotide sequence (SEQ ID NO: 172) and the amino acid sequence (SEQ ID NO: 39) of the mature heavy chain variable (VH) region of the anti-TIM3 monoclonal antibody 3G4. The CDR1 (SEQ ID NO: 45), CDR2 (SEQ ID NO: 51) and CDR3 (SEQ ID NO: 58) are delineated, and the V, D and J germline derivations are indicated.

FIG. 6B shows the nucleotide sequence (SEQ ID NO: 193) and the amino acid sequence (SEQ ID NO: 60) of the mature light chain variable (VL) region of the anti-TIM3 monoclonal antibody 3G4. The CDR1 (SEQ ID NO: 64), CDR2 (SEQ ID NO: 66) and CDR3 (SEQ ID NO: 68) are delineated, and the V and J germline derivations are indicated.

FIG. 6C shows the nucleotide sequence (SEQ ID NO: 172) and the amino acid sequence (SEQ ID NO: 39) of the heavy chain VH region of the anti-TIM3 monoclonal antibody 3G4 with a signal sequence (SEQ ID NOs: 275 and 270, respectively), and the nucleotide sequence (SEQ ID NO: 193) and the amino acid sequence (SEQ ID NO: 60) of the light chain VL region of the anti-TIM3 monoclonal antibody 3G4 with a signal sequence (SEQ ID NOs: 273 and 268, respectively).

FIG. 7A shows the nucleotide sequence (SEQ ID NO: 173) and the amino acid sequence (SEQ ID NO: 40) of the mature heavy chain variable (VH) region of the anti-TIM3 monoclonal antibody 17C8. The CDR1 (SEQ ID NO: 45), CDR2 (SEQ ID NO: 52) and CDR3 (SEQ ID NO: 59) are delineated, and the V, D and J germline derivations are indicated.

FIG. 7B shows the nucleotide sequence (SEQ ID NO: 194) and the amino acid sequence (SEQ ID NO: 61) of the mature light chain variable (VL) region of the anti-TIM3 monoclonal antibody 17C8. The CDR1 (SEQ ID NO: 64), CDR2 (SEQ ID NO: 66) and CDR3 (SEQ ID NO: 69) are delineated, and the V and J germline derivations are indicated.

FIG. 7C shows the nucleotide sequence (SEQ ID NO: 173) and the amino acid sequence (SEQ ID NO: 40) of the heavy chain VH region of the anti-TIM3 monoclonal antibody 17C8 with a signal sequence (SEQ ID NOs: 275 and 270, respectively), and the nucleotide sequence (SEQ ID NO: 194) and the amino acid sequence (SEQ ID NO: 61) of the light chain VL region of the anti-TIM3 monoclonal antibody 17C8 with a signal sequence (SEQ ID NOs: 273 and 268, respectively).

FIG. 8A shows the nucleotide sequence (SEQ ID NO: 420) and the amino acid sequence (SEQ ID NO: 410) of the mature heavy chain variable (VH) region of the anti-TIM3 monoclonal antibody 14H7. The CDR1 (SEQ ID NO: 45), CDR2 (SEQ ID NO: 413), and CDR3 (SEQ ID NO: 414) are delineated, and the V, D and J germline derivations are indicated.

FIG. 8B shows the nucleotide sequence (SEQ ID NO: 427) and the amino acid sequence (SEQ ID NO: 417) of the mature light chain variable (VL) region of the anti-TIM3 monoclonal antibody 14H7. The CDR1 (SEQ ID NO: 64), CDR2 (SEQ ID NO: 66), and CDR3 (SEQ ID NO: 69) are delineated, and the V and J germline derivations are indicated.

FIG. 8C shows the nucleotide sequence (SEQ ID NO: 420) and the amino acid sequence (SEQ ID NO: 410) of the heavy chain VH region of the anti-TIM3 monoclonal antibody 14H7 with a signal sequence (SEQ ID NOs: 362 and 361, respectively), and the nucleotide sequence (SEQ ID NO: 427) and the amino acid sequence (SEQ ID NO: 417) of the light chain VL region of the anti-TIM3 monoclonal antibody 14H7 with a signal sequence (SEQ ID NOs: 363 and 361, respectively).

FIG. 9A shows the nucleotide sequence (SEQ ID NO: 421) and the amino acid sequence (SEQ ID NO: 411) of the mature heavy chain variable (VH) region of the anti-TIM3 monoclonal antibody 23B3. The CDR1 (SEQ ID NO: 45), CDR2 (SEQ ID NO: 415), and CDR3 (SEQ ID NO: 416) are delineated, and the V, D and J germline derivations are indicated.

FIG. 9B shows the nucleotide sequence (SEQ ID NO: 193) and the amino acid sequence (SEQ ID NO: 60) of the mature light chain variable (VL) region of VK1 of the anti-TIM3 monoclonal antibody 23B3. The CDR1 (SEQ ID NO: 64), CDR2 (SEQ ID NO: 66), and CDR3 (SEQ ID NO:68) are delineated, and the V and J germline derivations are indicated.

FIG. 9C shows the nucleotide sequence (SEQ ID NO: 428) and the amino acid sequence (SEQ ID NO: 418) of the mature light chain variable (VL) region of VK2 of the anti-TIM3 monoclonal antibody 23B3. The CDR1 (SEQ ID NO: 64), CDR2 (SEQ ID NO: 66), and CDR3 (SEQ ID NO: 419) are delineated, and the V and J germline derivations are indicated.

FIG. 9D shows the nucleotide sequence (SEQ ID NO: 421) and the amino acid sequence (SEQ ID NO: 411) of the heavy chain VH region of the anti-TIM3 monoclonal antibody 23B3 with a signal sequence (SEQ ID NOs: 362 and 361, respectively), and the nucleotide sequences (SEQ ID NOs: 193 and 428, respectively) and the amino acid sequences (SEQ ID NO: 60 and 418, respectively) of the light chain VL region of VK1 and VK2 of the anti-TIM3 monoclonal antibody 23B3 with a signal sequence (SEQ ID NOs: 363 and 361, respectively).

FIG. 10A shows a sequence alignment of the heavy chain variable (VH) region of monoclonal antibodies 13A3 (SEQ ID NO: 34), 8B9 (SEQ ID NO: 35), 8C4 (SEQ ID NO: 36), 17C3 (SEQ ID NO: 37), 9F6 (SEQ ID NO: 38), 3G4 (SEQ ID NO: 39), 17C8 (SEQ ID NO: 40), 23B3 (SEQ ID NO: 411), and 14H7 (SEQ ID NO: 410). The complementarity determining regions (CDRs) are boxed.

FIG. 10B lists the SEQ ID NOs for the VH regions, each of the CDRs, and mutants thereof, of the antibodies in FIG. 10A.

FIG. 11A shows a sequence alignment of the light chain variable (VL) region of monoclonal antibodies 13A3 (SEQ ID NO: 60), 8B9 (SEQ ID NO: 61), 8C4 (SEQ ID NO: 61), 17C3 (SEQ ID NO: 60), 9F6_VK1 (SEQ ID NO: 62), 9F6_VK2 (SEQ ID NO: 63), 9F6_VK3 (SEQ ID NO: 61), 3G4 (SEQ ID NO: 60), 17C8 (SEQ ID NO: 61), 23B3_VK1 (SEQ ID NO: 60), 23B3_VK2 (SEQ ID NO: 418), and 14H7 (SEQ ID NO: 417). The complementarity determining regions (CDRs) are boxed.

FIG. 11B lists the SEQ ID NOs for the VL regions and each of the CDRs of the antibodies in FIG. 11A.

FIG. 12 shows a sequence alignment of the mature full length heavy chain (HC) of monoclonal antibody TIM3.5 (13A3) (SEQ ID NO: 15) and exemplary variants thereof: TIM3.13 (D101E) (SEQ ID NO: 95), TIM3.14 (P102V) (SEQ ID NO: 96), TIM3.15 (P102Y) (SEQ ID NO: 97), TIM3.16 (P102L) (SEQ ID NO: 98), TIM3.17 (N60Q/P102Y) (SEQ ID NO: 99), TIM3.18 (N60Q/D101E) (SEQ ID NO: 351), TIM3.10 (N60Q) (SEQ ID NO: 92), TIM3.11 (N60S) (SEQ ID NO: 93), and TIM3.12 (N60A) (SEQ ID NO: 94). The VH region of each of the heavy chains is underlined.

FIG. 13 shows a sequence alignment of the mature full length HC of monoclonal antibody 9F6 (SEQ ID NO: 19) and an exemplary variant TIM3.7 (A108T) (SEQ ID NO: 101) thereof. The VH region of each heavy chain is underlined.

FIG. 14 shows a sequence alignment of the mature full length HC of monoclonal 8B9 (SEQ ID NO: 16) and an exemplary variant TIM3.8 (S61P) (SEQ ID NO: 100) thereof. The VH region of each heavy chain is underlined.

FIG. 15 shows a sequence alignment of the mature full length HC of monoclonal antibody 23B3 (SEQ ID NO: 398) and an exemplary variant TIM3.25 (G6E/D79Y) (SEQ ID NO:404). The VH region of each heavy chain is underlined.

FIG. 16 lists the SEQ ID NOs of the full length heavy and light chains, variable regions and CDRs of hybridoma derived antibodies (13A3, 8B9, 8C4, 17C3, 9F6, 3G4, 17C8, 14H7, and 23B3) and recombinant (TIM3.2-TIM3.18, TIM3.24, and TIM3.25) anti-human TIM3 antibodies. The isotype of the heavy and light chains is also indicated. "H.n." refers to hybridoma name. Heavy and light chains that are referred to in FIG. 16 can be derived from its elements, e.g., variable and constant regions that are disclosed herein. Where a SEQ ID NO does not appear in a given column on the second or third page of the table, it is provided in that column in the page preceding it or the page preceding that one.

Figure 17B:
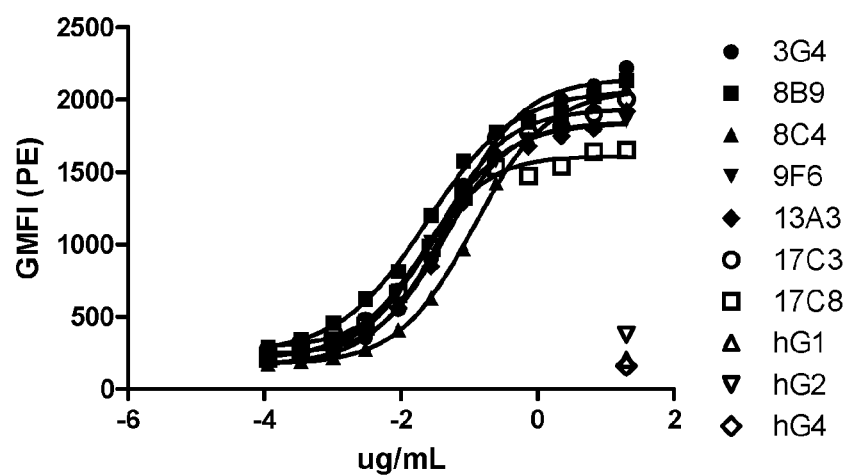

FIGS. 17A and 17B show the binding curves and ECs values of several anti-TIM3 antibodies to human TIM3 transfected CHO cells (FIG. 17A) and activated human T cells (FIG. 17B). In FIG. 17A, the following anti-TIM3 antibodies are shown: 13A3, 17C3, 17C8, 3G4, 8B9, and 9F6. In FIG. 17B, the following anti-TIM3 antibodies are shown: 13A3, 17C3, 17C8, 3G4, 8B9, 8C4, and 9F6. In both FIGS. 17A and 17B, isotype control antibodies human IgG1 (hG1), IgG2 (hG2), and IgG4 (hG4) were used as negative controls.

Figure 18:
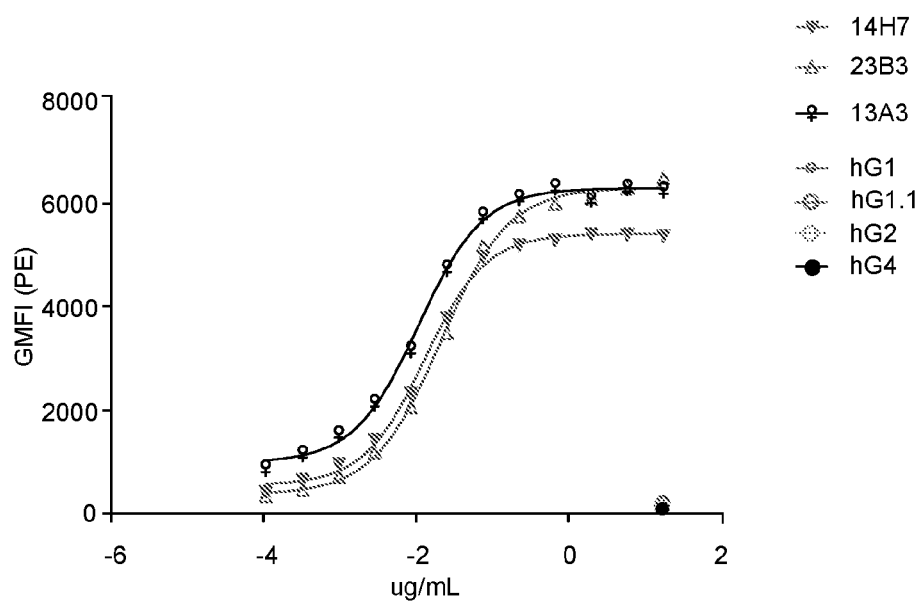

FIG. 18 shows a comparison of the binding curves and $EC_{50}$ values of anti-TIM3 antibodies 14H7 and 23B3 to anti-TIM3 antibody 13A3 binding to human TIM3 positive cells. The isotype control antibodies IgG1, IgG1.1 (hG1.1), IgG2, and IgG4 were used as negative controls.

Figure 19A:
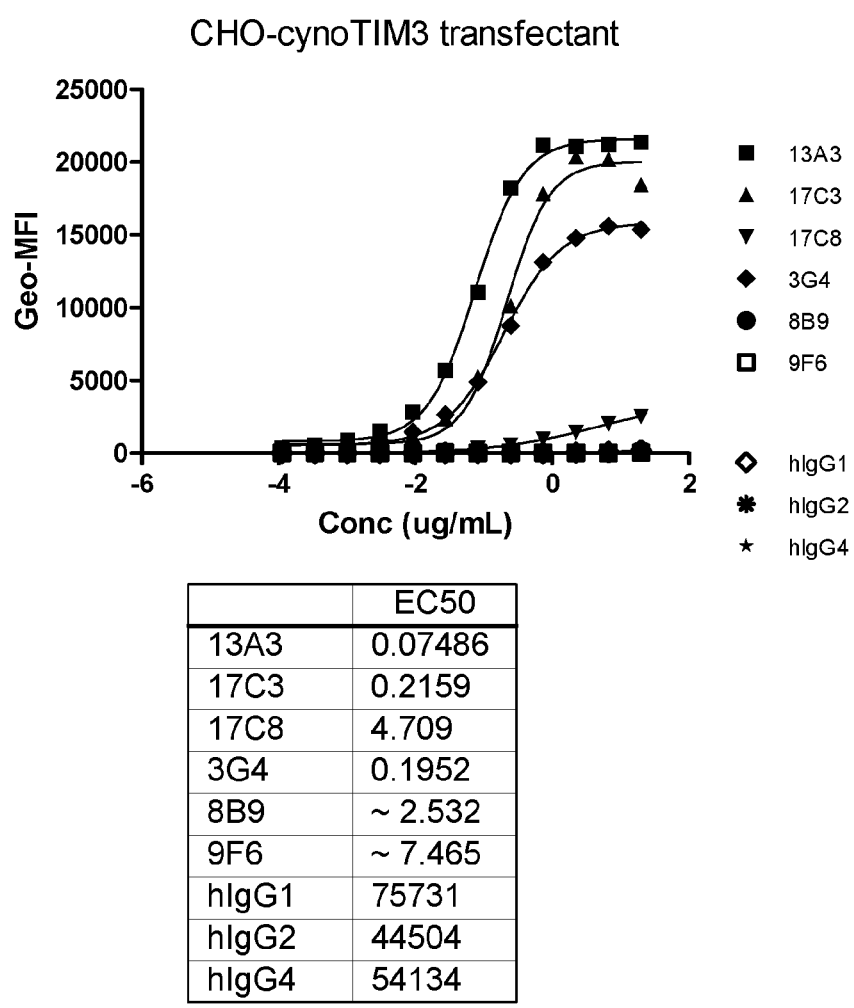
Figure 19B:
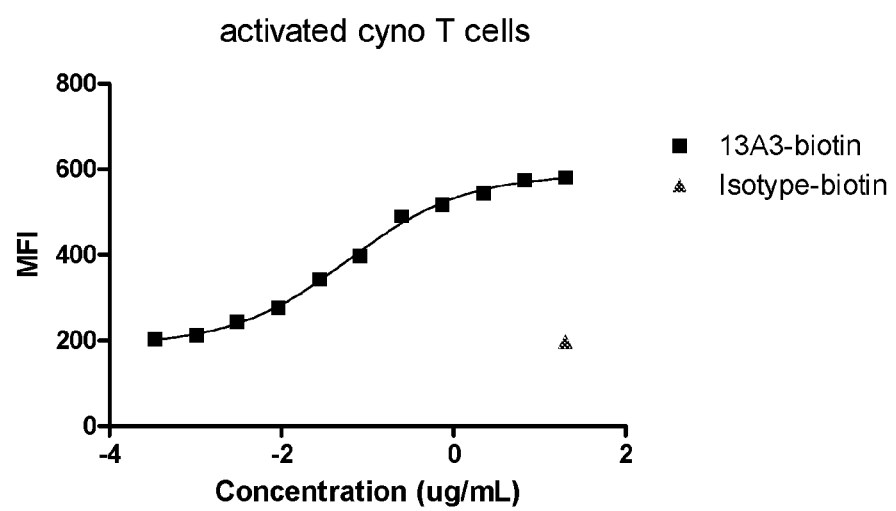
Figure 19C:
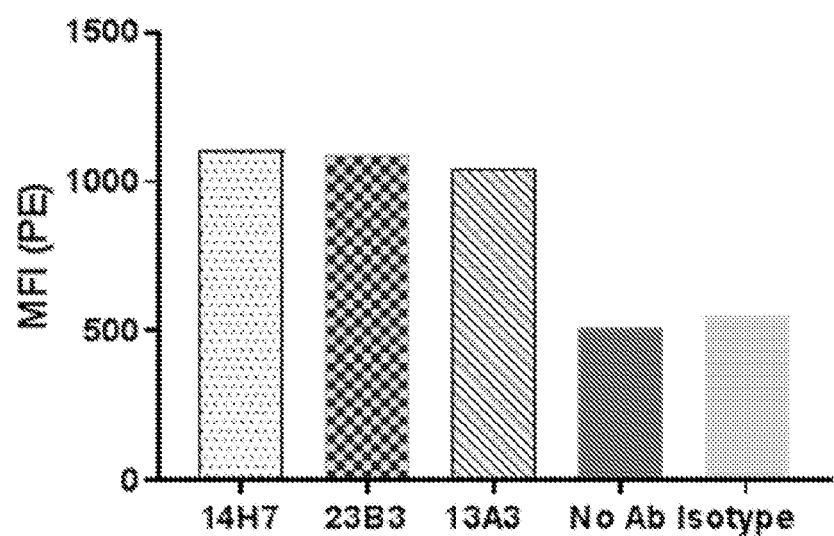

FIGS. 19A, 19B, and 19C show the binding analysis of anti-TIM3 antibodies to a cyno TIM3-transfected CHO cell line (FIG. 19A) and activated cyno T cells (FIGS. 19B and 19C). In FIG. 19A, binding curves and ECs values for anti-TIM3 antibodies 13A3, 17C3, 17C8, 3G4, 8B9, and 9F6 are provided. In FIG. 19B, binding curve and ECs value for anti-TIM3 antibody 13A3 are provided. In FIG. 19C, 100 ug of the relevant antibodies were tested for binding to activated cynomolgus CD8+ T cells. The binding data is shown as mean fluorescence index (MFI). In FIGS. 19A-19C, the relevant isotype control antibodies (hIgG1, hIgG2, and hIgG4) or no antibody treatment (No Ab) were used as negative controls.

Figure 20:
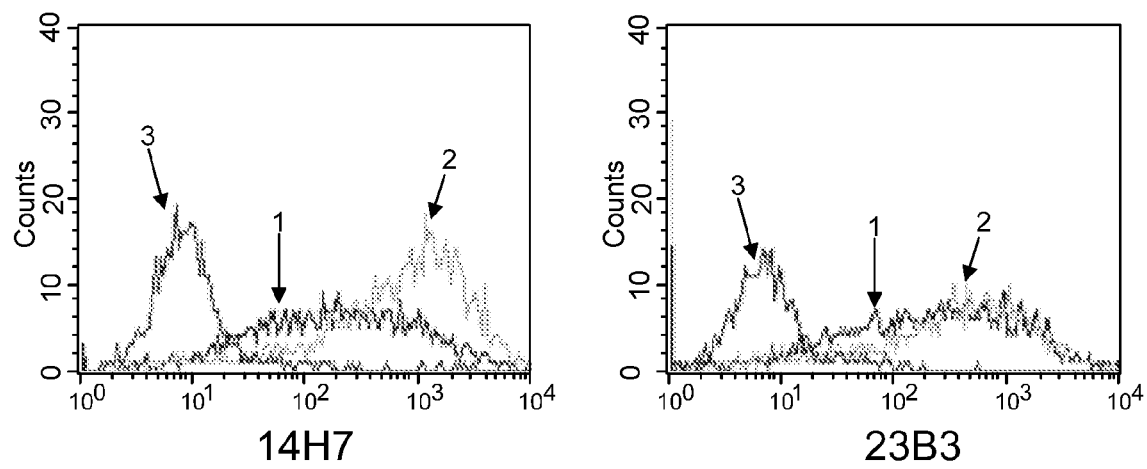

FIG. 20 shows a flow cytometry histogram of the binding of anti-TIM3 antibodies 14H7 (left panel) and 23B3 (right panel) to CHO cells transfected with either human TIM3 ("1") or cyno TIM3 ("2"). CHO cells transfected with the isotype control antibody were used as a negative control ("3").

Figure 21:
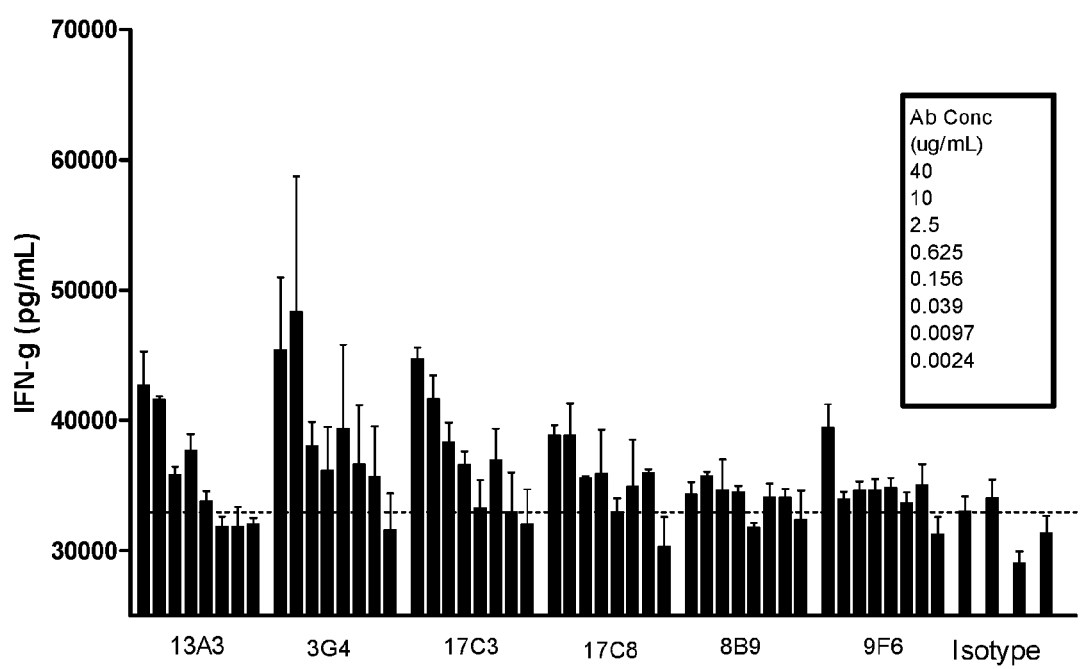

FIG. 21 shows anti-TIM3 activity (at various antibody concentrations as shown in the boxed legend) in promoting IFN-γ production from tumor infiltrating leukocytes (TILs) in renal cell carcinoma (RCC). The 8 bars for each antibody represent different concentrations of antibody, as indicated. Data for anti-TIM3 antibodies 13A3, 3G4, 17C3, 17C8, 8B9, and 9F6 are shown. An isotype control antibody was used as a control. The dashed horizontal line provides the background threshold level.

Figure 22A:
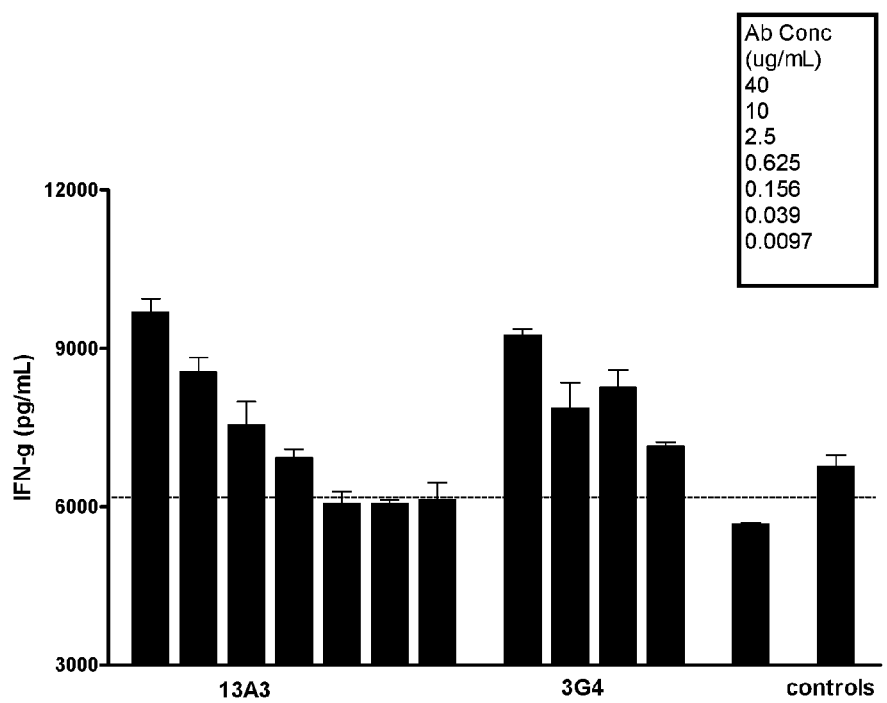
Figure 22B:
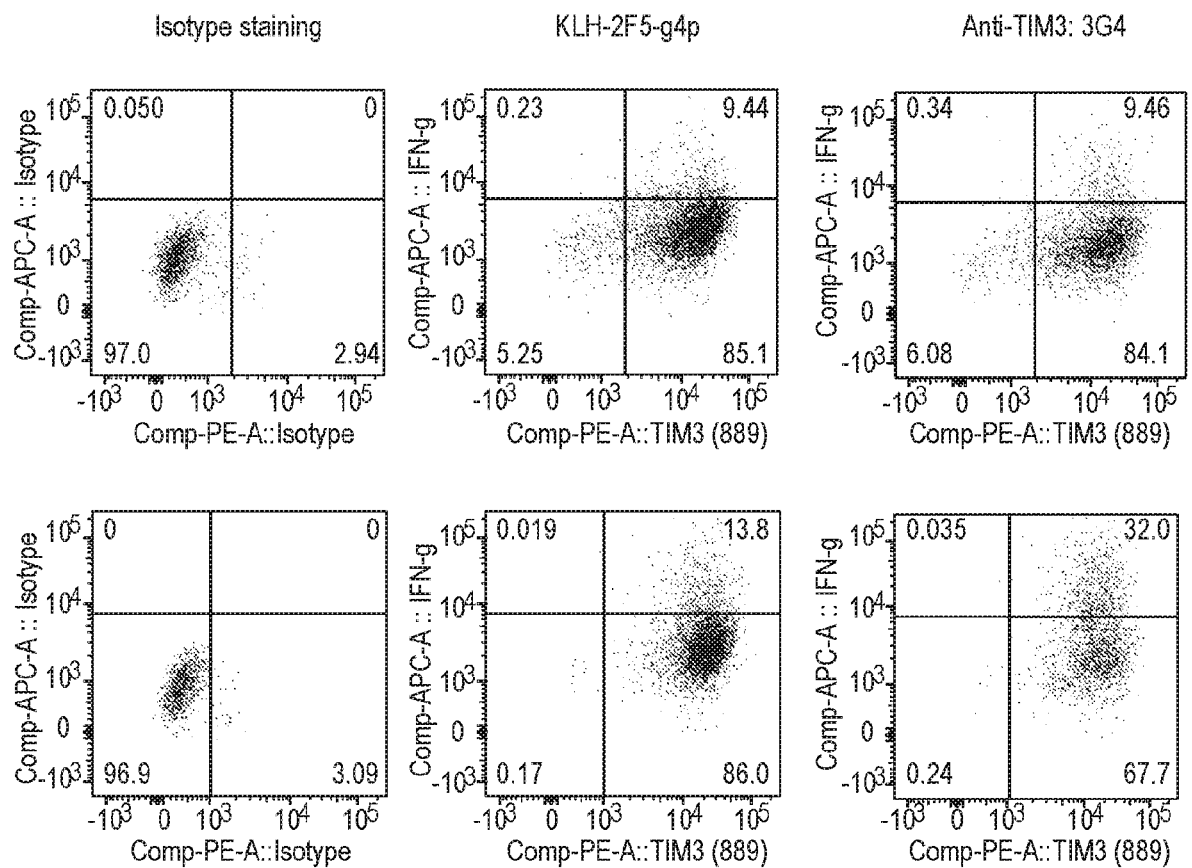

FIGS. 22A and 22B show anti-TIM3 activity (at various antibody concentrations as shown in the boxed legend) in promoting IFN-γ production from lung cancer TILs (FIG. 22A, IFN-γ ELISA; FIG. 22B, intracellular IFN-γ staining). In FIG. 22A, the individual bar for each antibody shown (13A3 and 3G4) represents different concentrations of antibody, as indicated. In FIG. 22B, the upper panel shows CD4+ T cells and the lower panel shows CD8+ T cells. The level of TIM3 was measured with 8B9 (x-axis). In FIG. 22B, a non-TIM3 specific antibody (KLH-2F5-g4p) was used as a control. The x-axis shows TIM3 expression and the y-axis shows IFN-γ expression.

Figure 23:
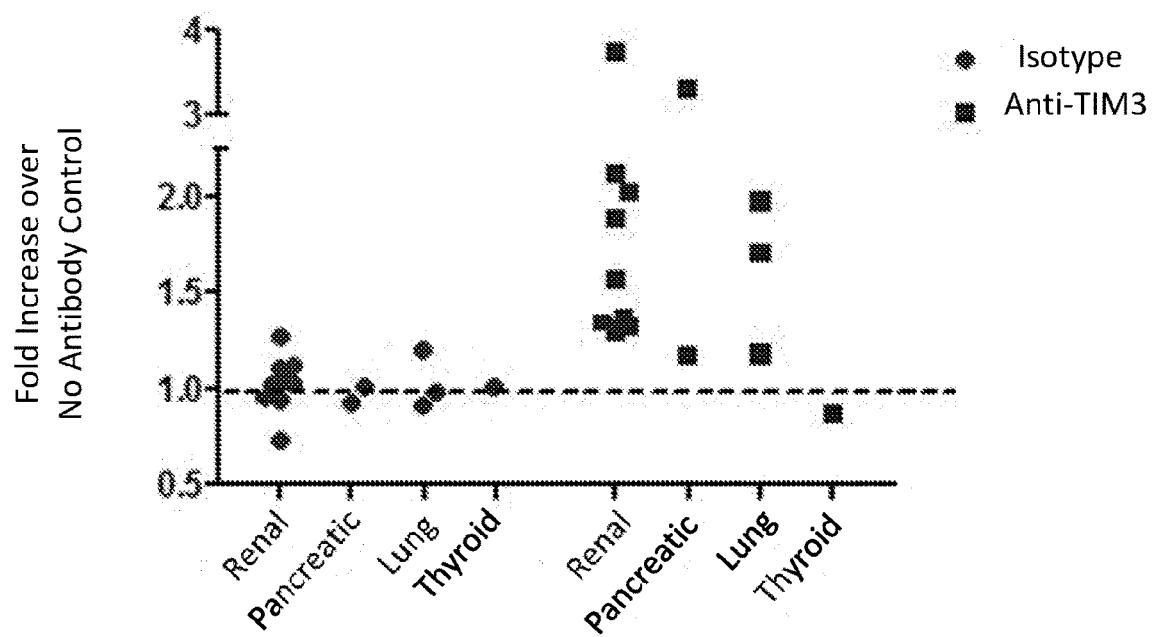

FIG. 23 shows the efficacy of anti-TIM3 antibodies (i.e., antibodies 13A3 and 3G4) in promoting IFN-γ secretion from TILs isolated from various tissues (i.e., renal, pancreatic, lung, and thyroid) of patients and cultured in vitro with either anti-TIM3 antibody 13A3 or 3G4. IFN-γ secretion was measured in the presence of CHO-OKT3 cells. Data is shown as fold-increase over the level of IFN-γ produced by TILs in the absence of anti-TIM3 antibodies.

Figure 24A:
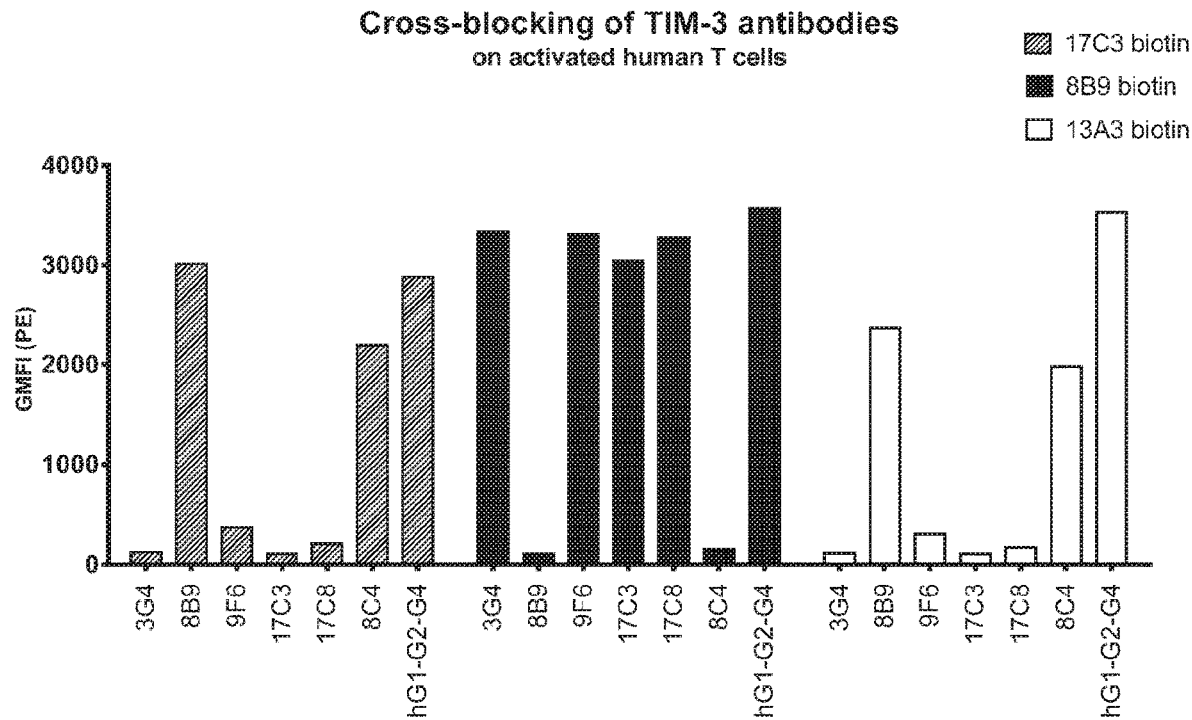
Figure 24B:
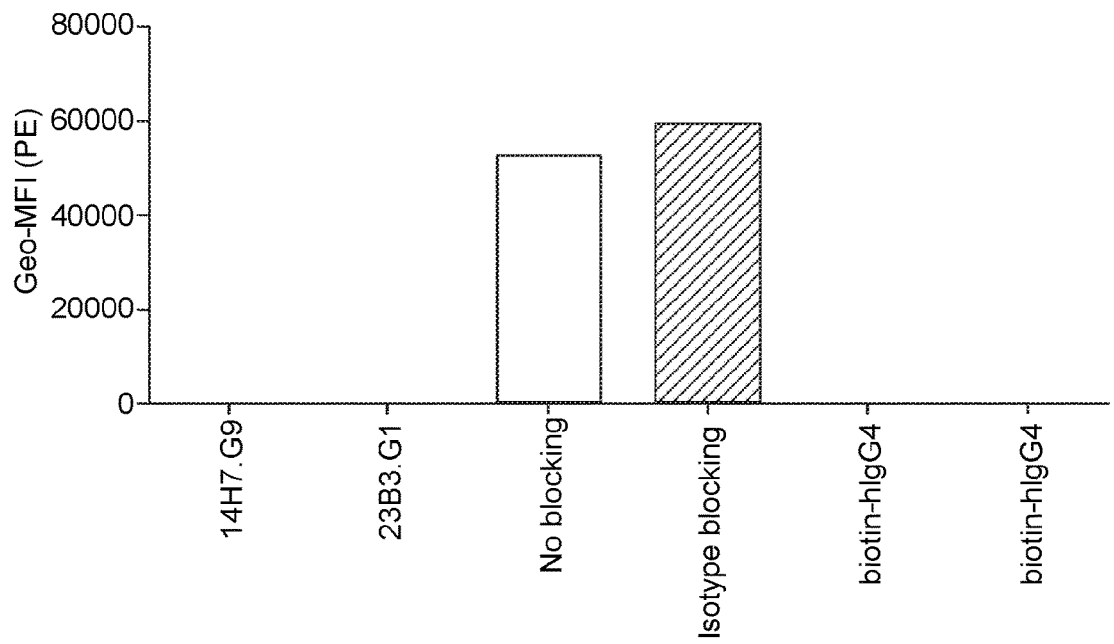

FIGS. 24A and 24B show the cross-blocking data of the anti-TIM3 antibodies on activated human T cells. In FIG. 24A, the binding of anti-TIM3 antibodies 17C3 (dark gray), 8B9 (black), and 13A3 (light gray) to activated human T cells pre-incubated with one of the following anti-TIM3 antibodies: 3G4, 8B9, 9F6, 17C3, 17C8, and 8C4. In FIG. 24B, the activated human T cells were preincubated with either the 14H7 or the 23B3 antibody and then, the binding of the 13A3 antibody was measured. In both FIGS. 24A and 24B, the geometric mean fluorescence intensity of the binding of the anti-TIM3 antibodies to the activated human T cells is provided.

FIG. 25 shows the amino acid residues that are necessary for binding of anti-TIM3 monoclonal antibodies 13A3, 3G4, 17C3 and 8B9 to human TIM3 (SEQ ID NO: 286). The signal sequence and the transmembrane domains are underlined. The amino acid sequences CPVFEC and CPVFECG are SEQ ID NOs: 475 and 296, respectively.

Figure 26A:
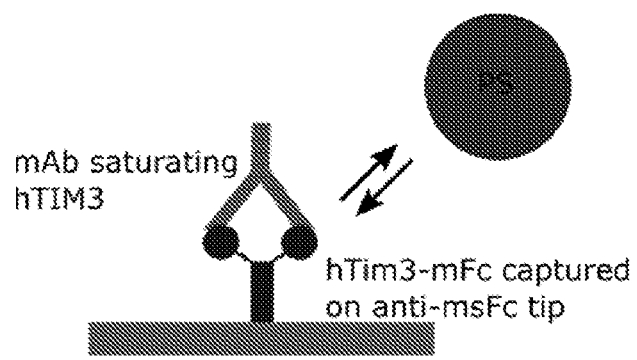
Figure 26B:
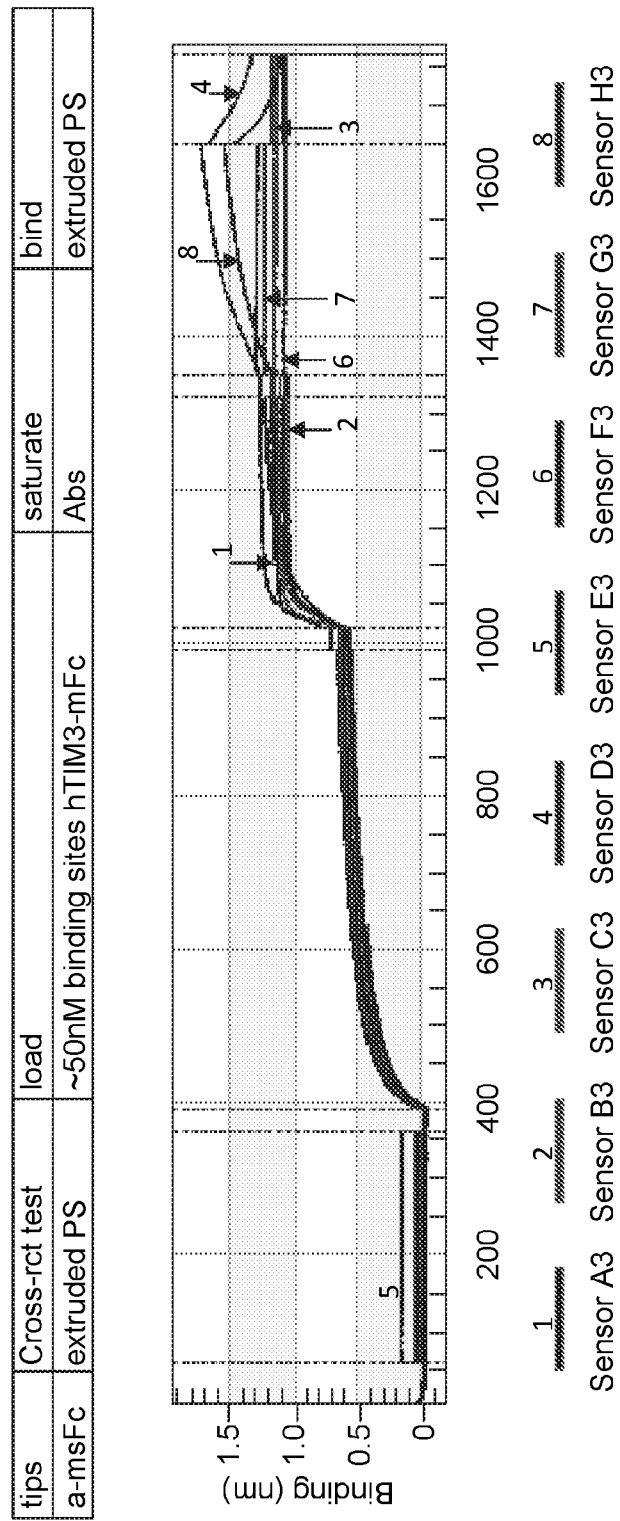
Figure 26B:
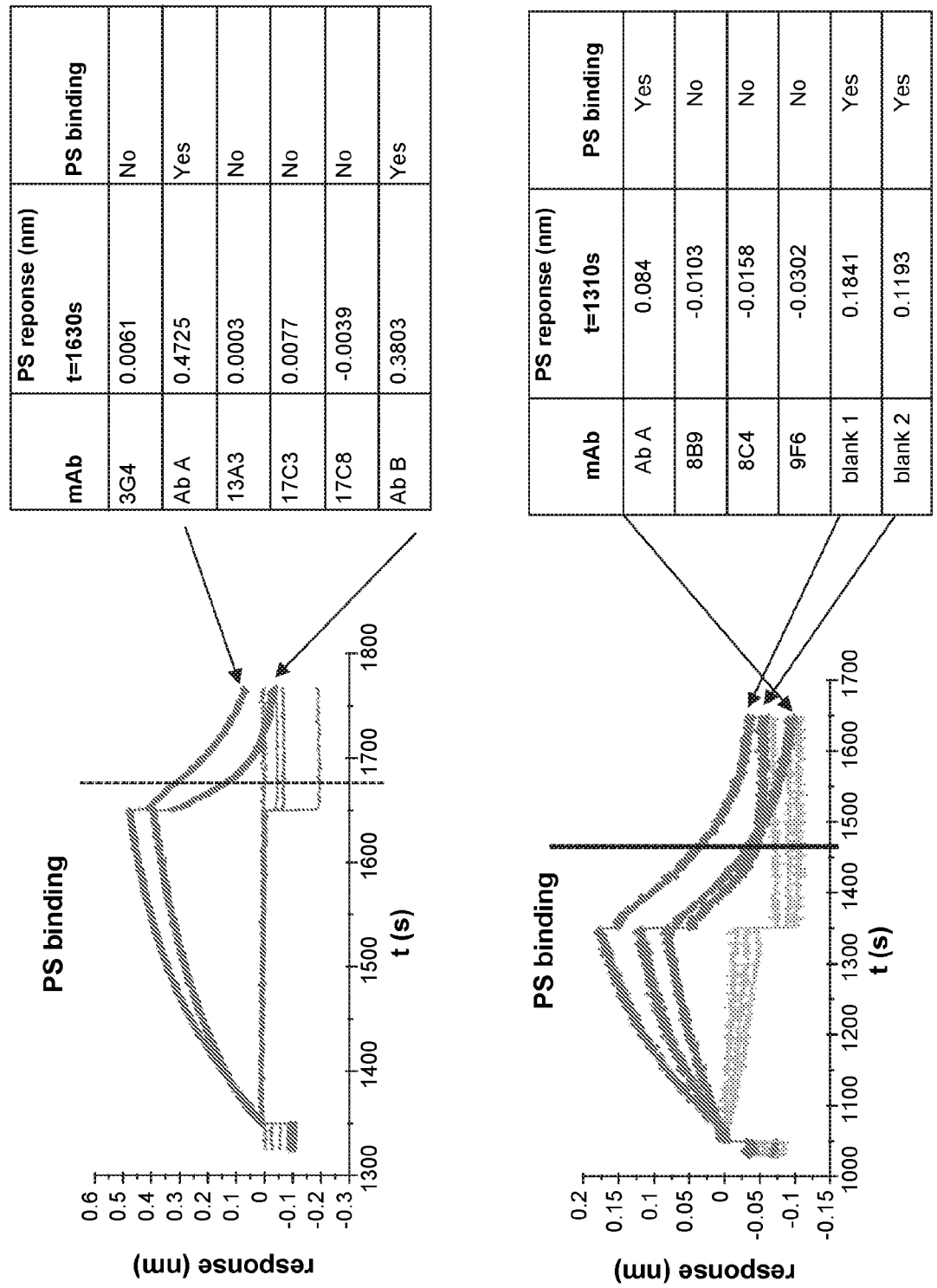

FIGS. 26A and 26B show that certain anti-TIM3 antibodies block the interaction between human TIM3 and PS-liposome. FIG. 26A shows a schematic diagram of the phosphatidylserine (PS)-hTIM3 "in-tandem" blocking assay. FIG. 26B shows blocking of binding of hTIM3-Fc to PS-liposome by certain anti-TIM3 antibodies, as measured via the PS-hTIM3 "in-tandem" blocking assay shown in FIG. 26A. The top row shows data for anti-TIM3 antibodies 3G4, 13A3, 17C3, and 17C8. The bottom row shows data for anti-TIM3 antibodies 8B9, 8C4, and 9F6. Both the PS response time and whether the hTIM3-Fc bound to PS-liposome are provided in the table to the right of each graph.

FIG. 27 shows a summary of the functional activity of various anti-TIM3 antibodies (e.g., TIM3.5 (13A3), TIM3.4 (3G4), TIM3.2 (17C3), TIM3.9 (17C8), 9F6, TIM3.8 (8B9 with S61P substitution in the VH) and TIM3.6 (8C4)). Data for the binding assay, T-cell assay, TIL assay, and PS-TIM3 blocking assay are provided.

FIG. 28 provides a listing of all SEQ ID Numbers with a description of the sequences represented by the SEQ ID Numbers.

Figure 29A:
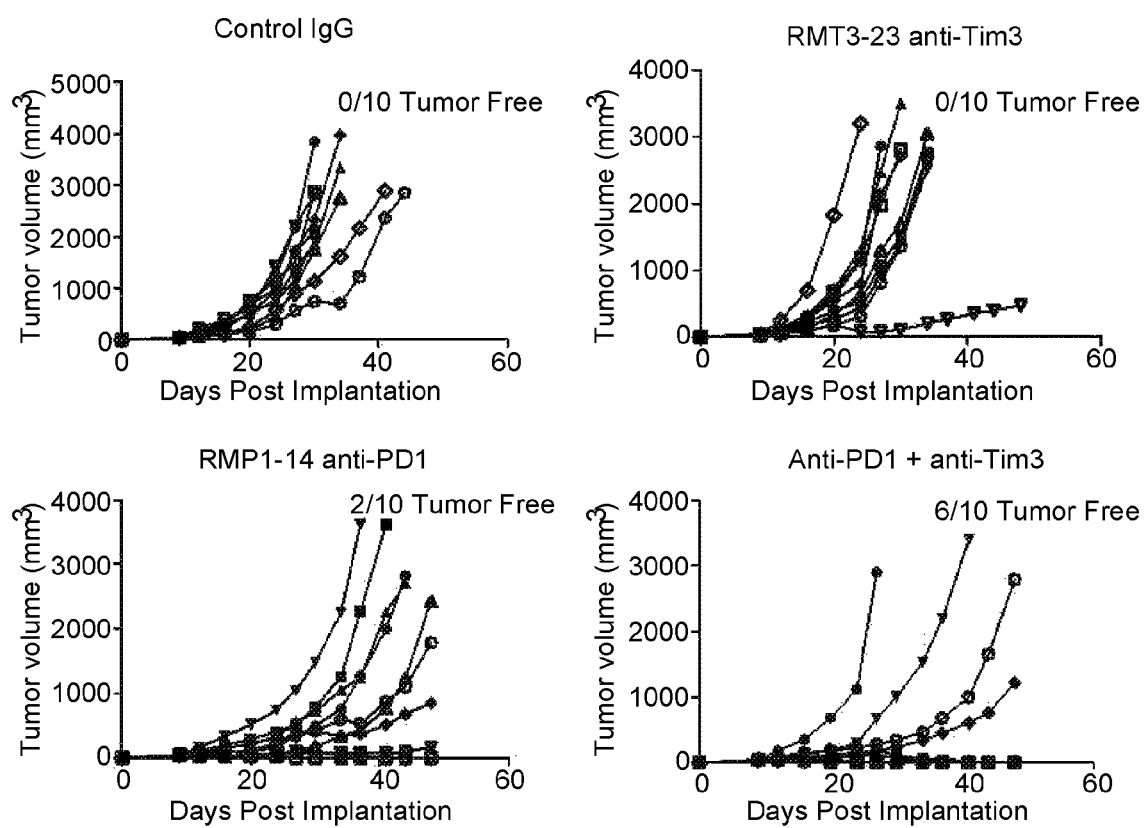
Figure 29B:
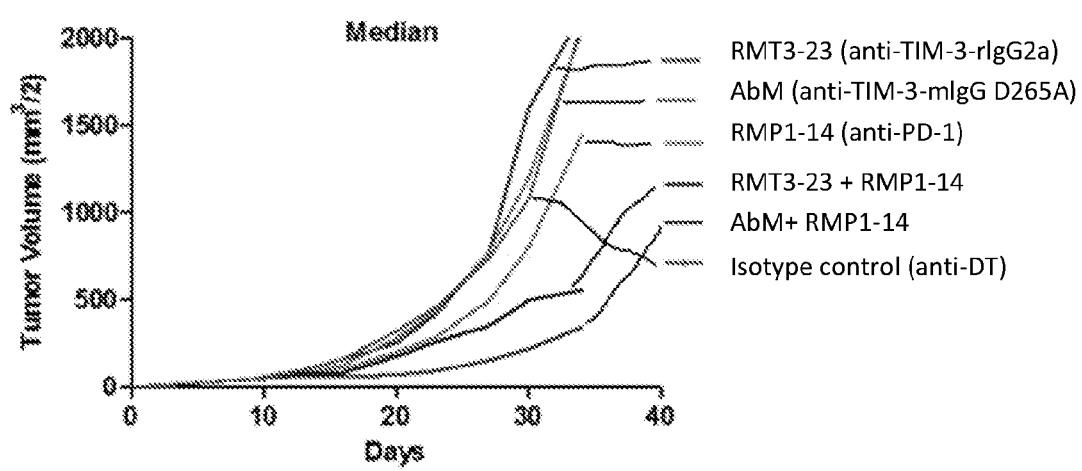

FIGS. 29A and 29B show the anti-tumor activity of the combined administration of anti-PD1 and anti-TIM3 antibodies in the CT26 colorectal tumor mouse model. FIG. 29A shows the tumor volume at various time points post tumor implantation in mice (n=10/group) treated with the (i) control IgG (upper left panel), (ii) RMT3-23 anti-TIM3 antibody alone (upper right panel), (iii) RMP1-14 anti-PD1 antibody alone (bottom left panel), and (iv) combination of the RMT3-23 anti-TIM3 and RMP1-14 anti-PD1 antibodies (bottom right panel). FIG. 29B shows the average tumor volume as a function of time (days post tumor implantation) in mice treated with (i) RMT3-23 anti-TIM3 antibody alone, (ii) AbM anti-TIM3 antibody alone, (iii) RMP1-14 anti-PD1 antibody alone, (iv) combination of RMT3-23 anti-TIM3 and RMP1-14 anti-PD1 antibodies, (v) combination of Ab M anti-TIM3 and RMP1-14 anti-PD1 antibodies, and (vi) isotype control antibody.

Figure 30:
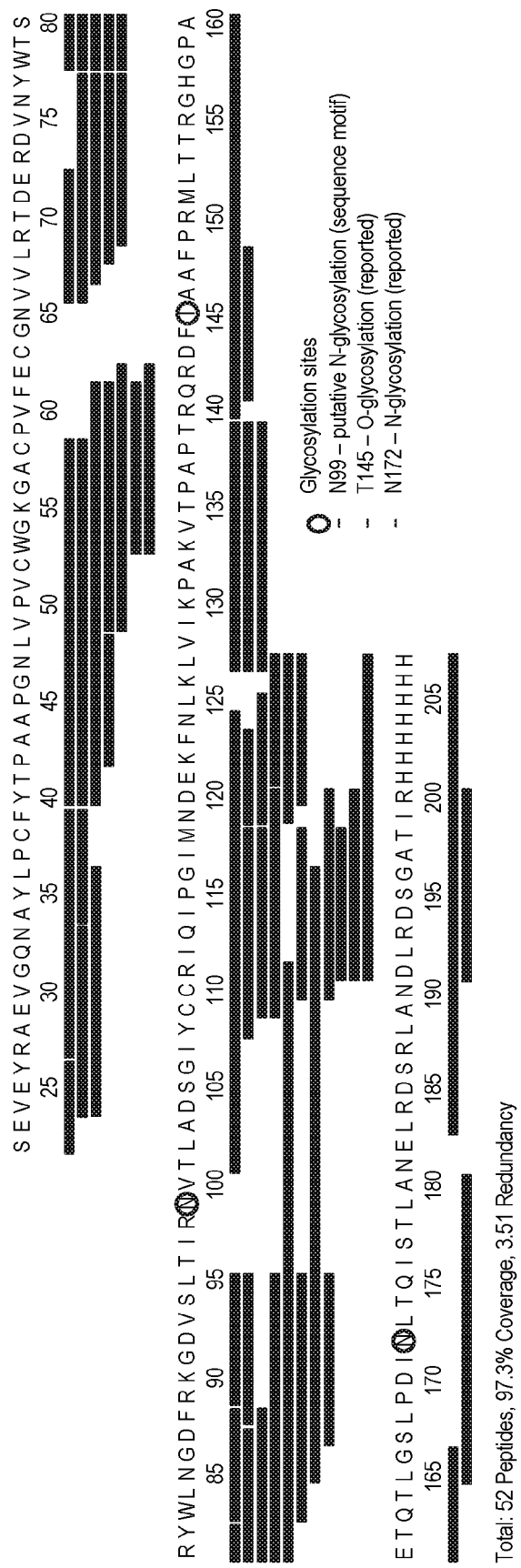

FIG. 30 shows the list of common peptides of hTIM3 that were used to map the epitopes of the anti-TIM3 antibodies (13A3 and 3G4) using hydrogen/deuterium exchange mass spectrometry (HDX-MS). Each bar indicates a peptic peptide. The circled residues (i.e., N99, T145, and N172) indicate the glycosylation sites. The amino acid sequence shown is SEQ ID NO: 476.

Figure 31:
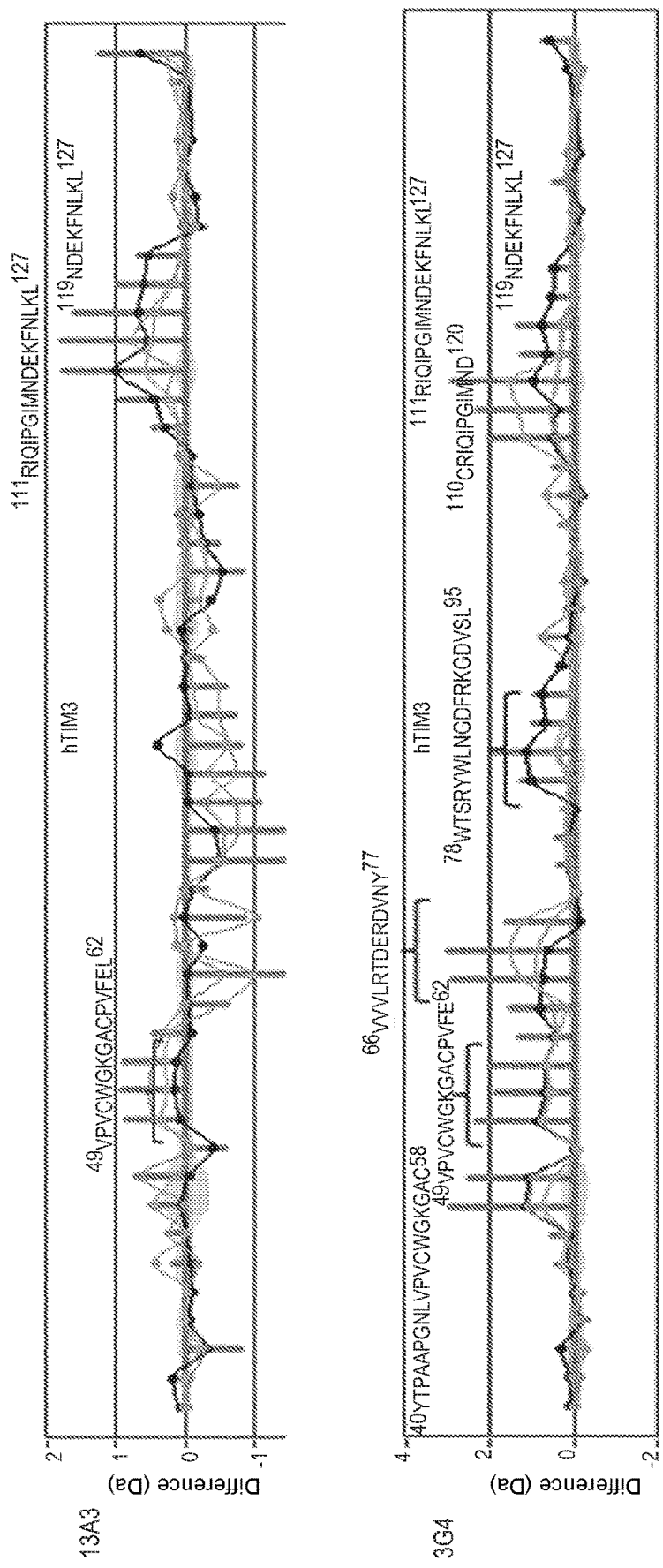

FIG. 31 shows the human TIM3 binding regions of the anti-TIM3 antibodies (13A3 and 3G4) identified using HDX-MX. The upper panel shows the binding region of the 13A3 anti-TIM3 antibody. The bottom panel shows the binding region of the 3G4 anti-TIM3 antibody. The amino acid sequences shown are: VPVCWGKGACPVFEL (SEQ ID NO: 477), RIQIPGIMNDEKFNLKL (SEQ ID NO: 368), NDEKFNLKL (SEQ ID NO: 373), YTPAAPGNLVPVCWGKGAC (SEQ ID NO: 478), VPVCWGKGACPVFE (SEQ ID NO: 367), VVVLRTDER-DVNY (SEQ ID NO: 479), WTSRYWLNGDFRKGDVSL (SEQ ID NO: 371), and CRIQIPGIMND (SEQ ID NO: 480).

Figure 32A:
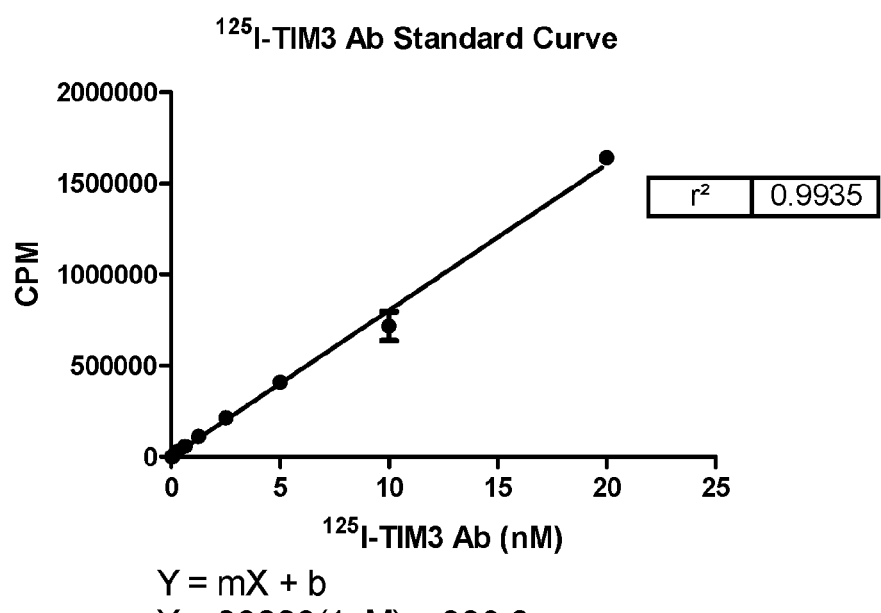
Figure 32B:
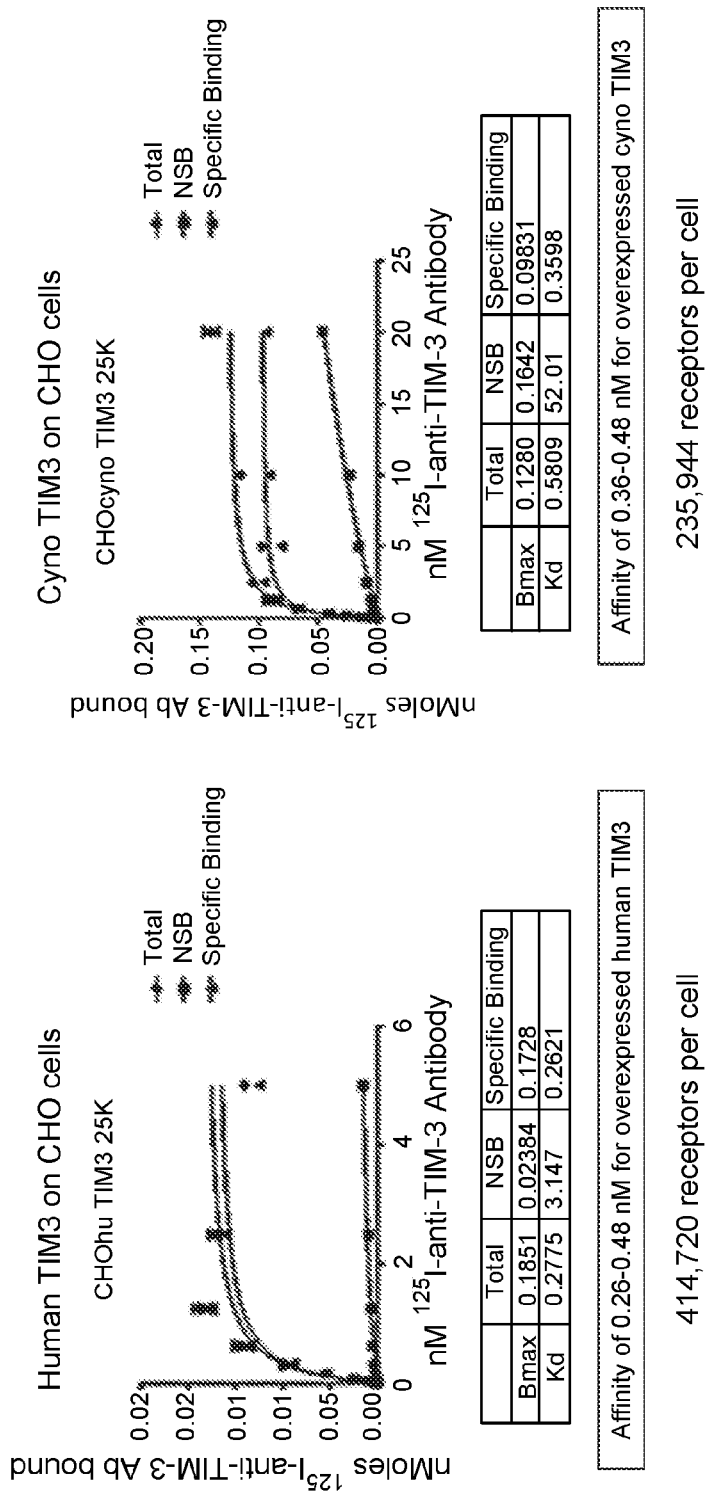

FIGS. 32A and 32B show the results of a Scatchard analysis of the binding of TIM3.18.IgG1.3 to CHO cells ectopically expressing human or cyno TIM3. FIG. 32A shows a $^{125}$I-TIM3 Ab standard curve. FIG. 32B shows the amount of TIM3.18.IgG1.3 antibody bound to CHO cells expressing human (left panel) and cyno (right panel) TIM3. Below each of the graphs is provided the estimated affinity value and the number of TIM3 molecules expressed on the surface of the CHO cells. These values were calculated as described in Example 4.

Figure 33:
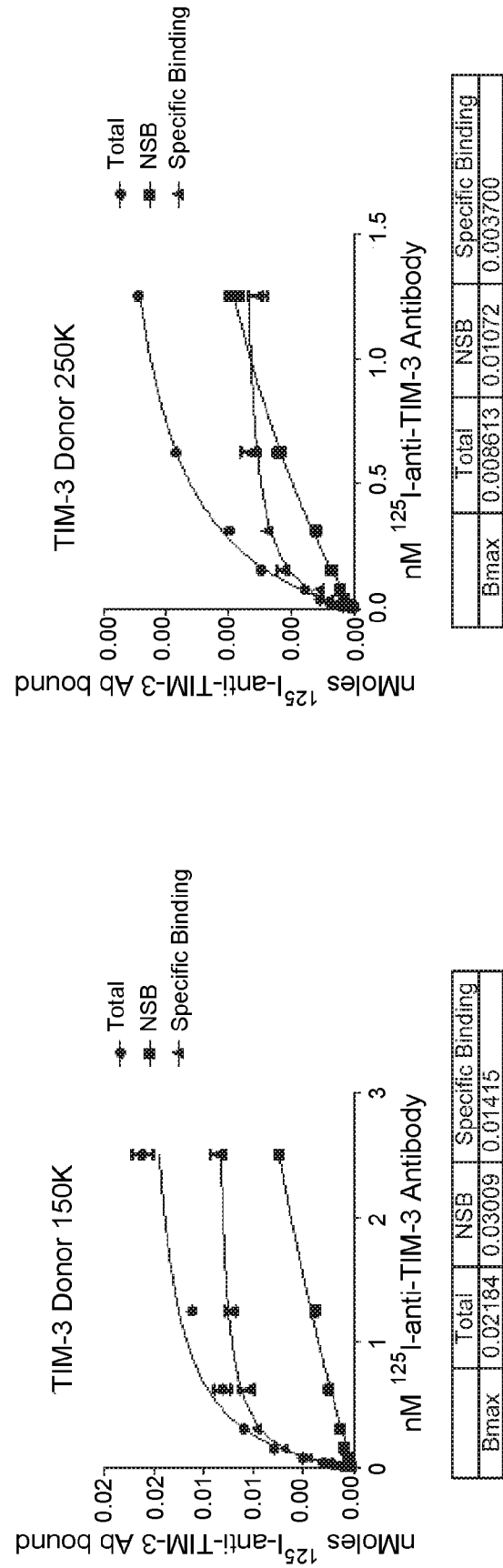

FIG. 33 shows the results of a Scatchard analysis of the binding of TIM3.18.IgG1.3 to activated Th1 cells from two separate donors (left and right panels). Below each of the graphs is provided the estimated affinity value and the number of TIM3 molecules expressed on the surface of the CHO cells. These values were calculated as described in Example 4.

Figure 34A:
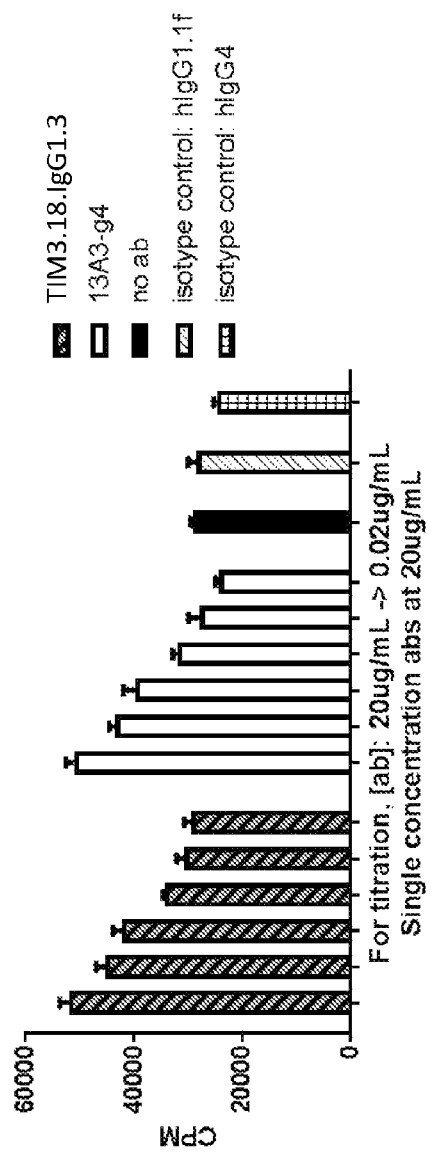
Figure 34B:
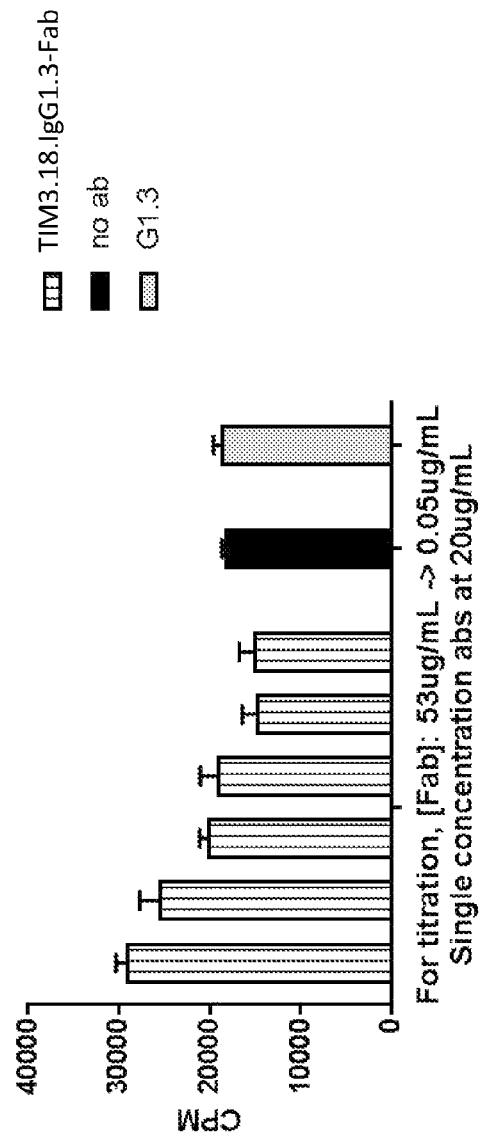

FIGS. 34A and 34B show TIM3.18.IgG1.3 and TIM3.18.IgG1.3 Fab enhanced proliferation of Th1 T cells in the polarized Th1/irradiated CHO-OKT3 co-culture assay. FIG. 34A shows Th1 cell proliferation observed with various concentrations of TIM3.18.IgG1.3, 13A3 ("13A3-g4"), with no antibody, or isotype control antibodies (hIgG1.1 or hIgG4). Each of the bars for an antibody represent a different concentration.

FIG. 34B shows Th1 cell proliferation observed with various concentrations of TIM3.18.IgG1.3 Fab, with no antibody ("no ab"), or isotype control antibody IgG1.3 ("G1.3"). Each of the bar for the TIM3.18 antibody represents a different concentration.

Figure 35:
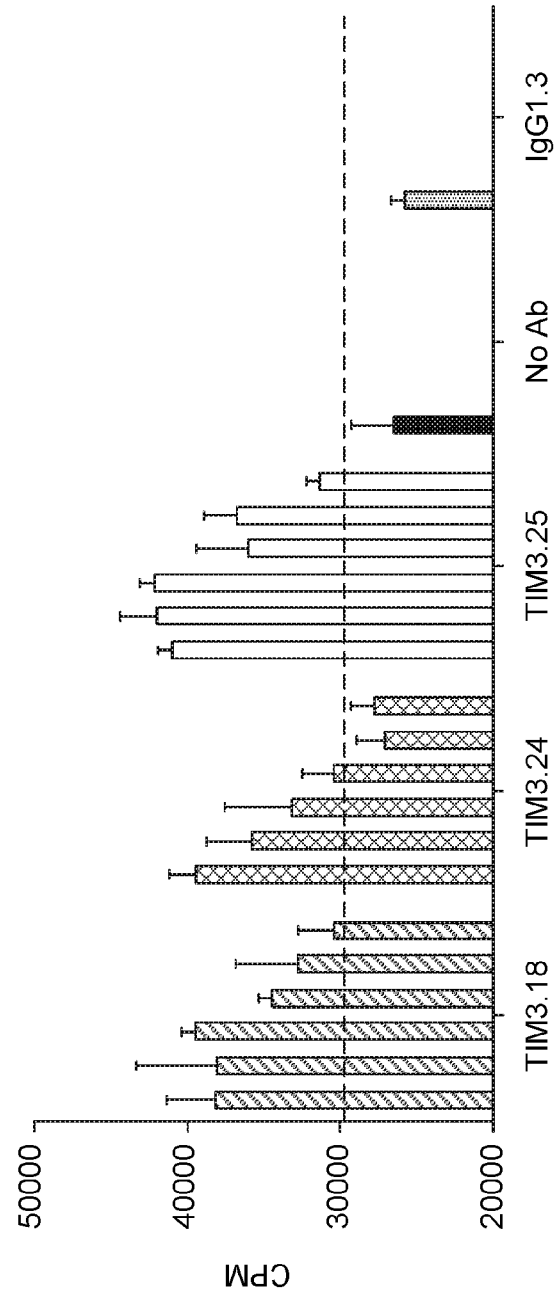

FIG. 35 shows TIM3.24 and TIM3.25 mediated enhanced proliferation of Th1 T cells in the polarized Th1/irradiated CHO-OKT3 co-culture assay. TIM3.18 antibody was included for comparison purposes. CHO cells that were not treated with any antibody ("No Ab") or treated with an isotype control IgG1.3 antibody ("IgG1.3") were used as negative controls. The dotted horizontal line indicates proliferation over the negative control.

Figure 36:
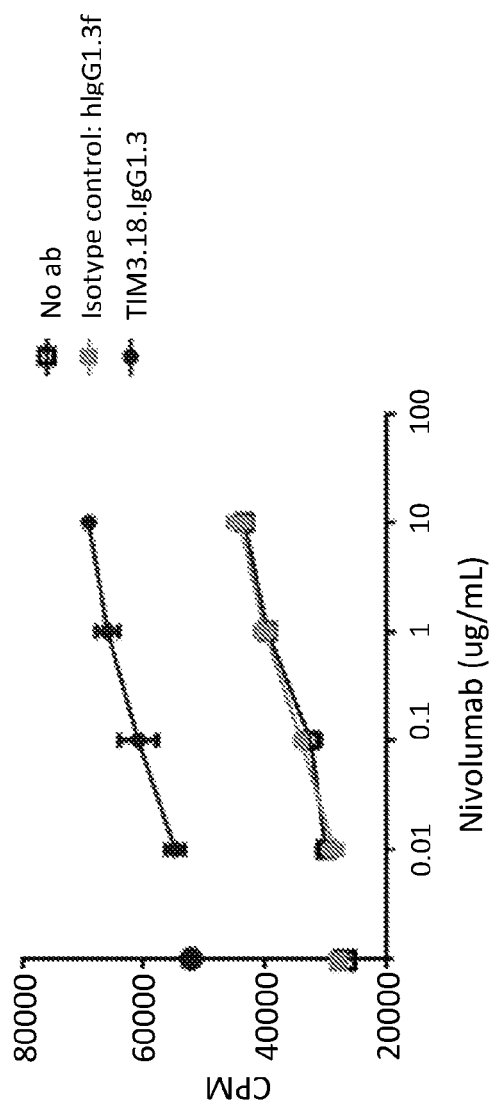

FIG. 36 shows that anti-TIM3 antibody TIM3.18.IgG1.3 (black circle) enhanced proliferation of Th1 T cells in the polarized Th1/irradiated CHO-OKT3-PD-L1 co-culture assay in combination with nivolumab. CHO cells that were not treated with any antibody (open square) or treated with an isotype control IgG1.3 antibody (gray square) were used as negative controls.

Figure 37:
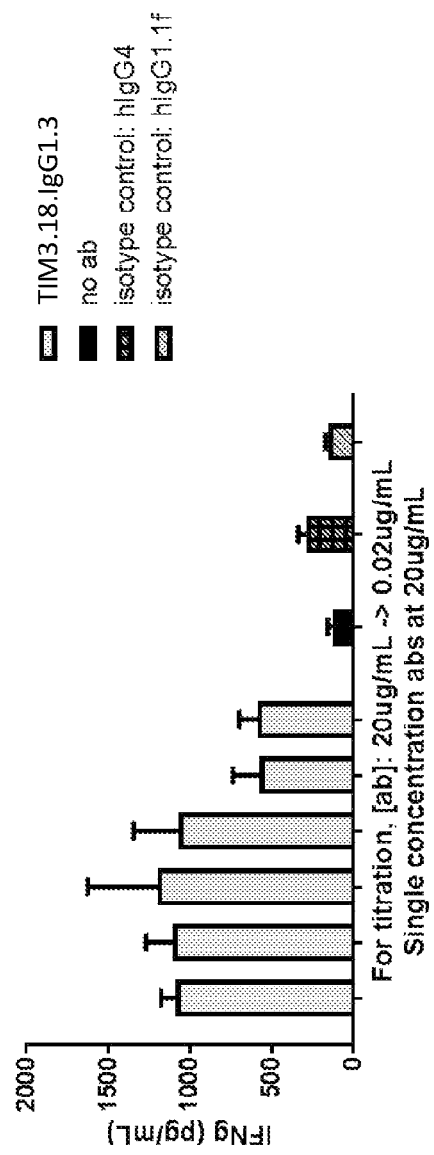

FIG. 37 shows that anti-TIM3 antibody TIM3.18.IgG1.3 enhanced interferon-γ secretion of renal cell carcinoma tumor infiltrating lymphocytes (TILs) after stimulation with irradiated CHO-OKT3 cells. The TILs stimulated with CHOs in the presence of an isotype control antibody (hIgG4 or hIgG1.1f) or no antibodies at all were used as negative controls. Each of the bars for the TIM3.18 antibody represents a different concentration of the antibody.

Figure 38:
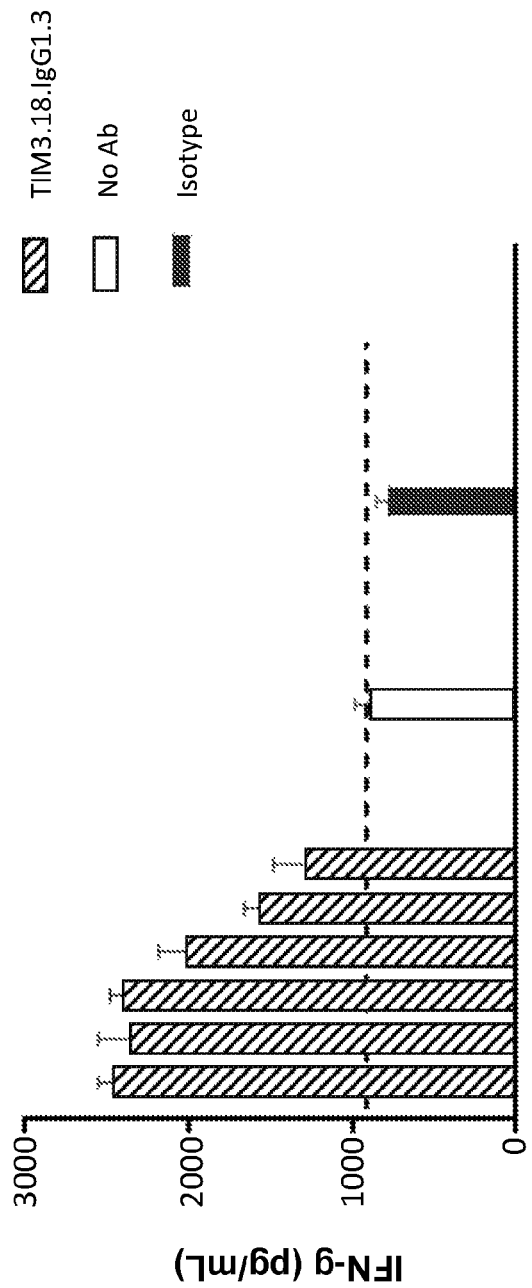

FIG. 38 shows that anti-TIM3 antibody TIM3.18.IgG1.3 enhanced interferon-γ secretion of breast cancer TILs stimulated with irradiated CHO-OKT3 cells. Assays with no antibody or an isotype control antibody were used as controls. The dotted horizontal line indicates interferon-γ secretion above the negative controls.

Figure 39:
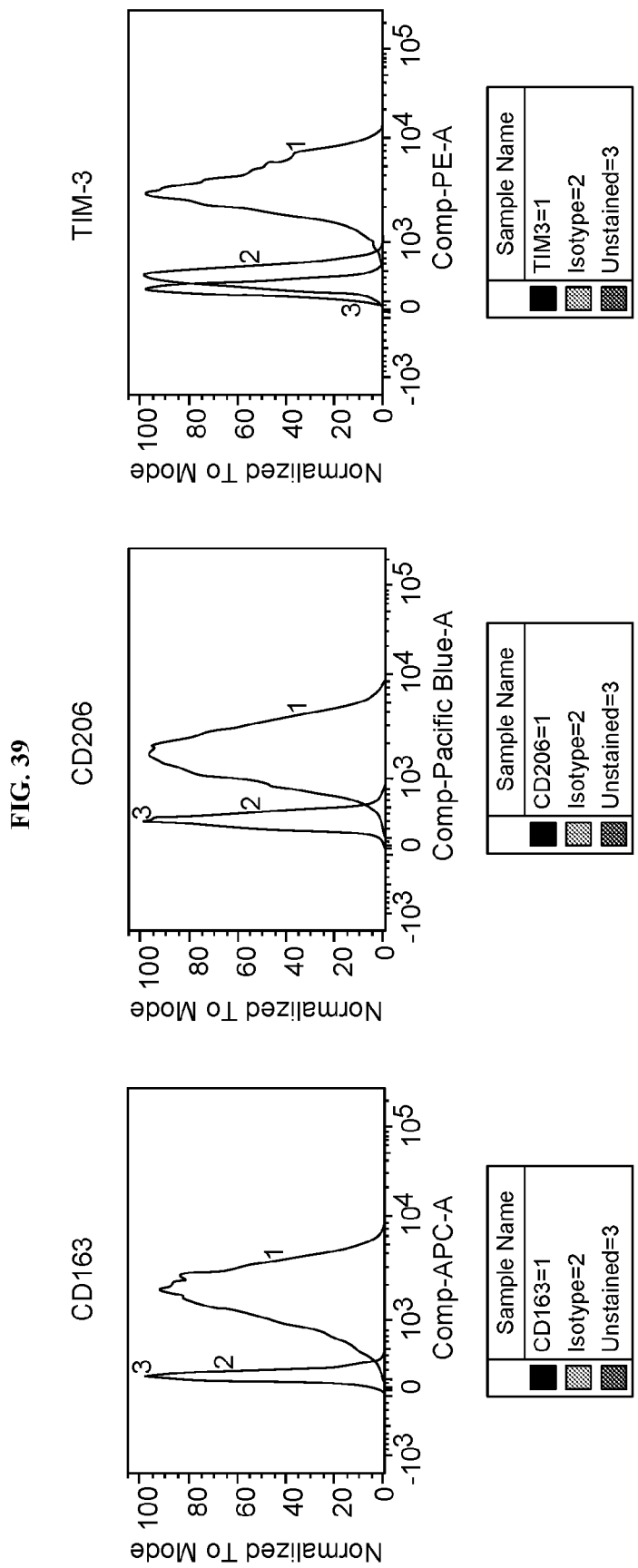
Figure 40:
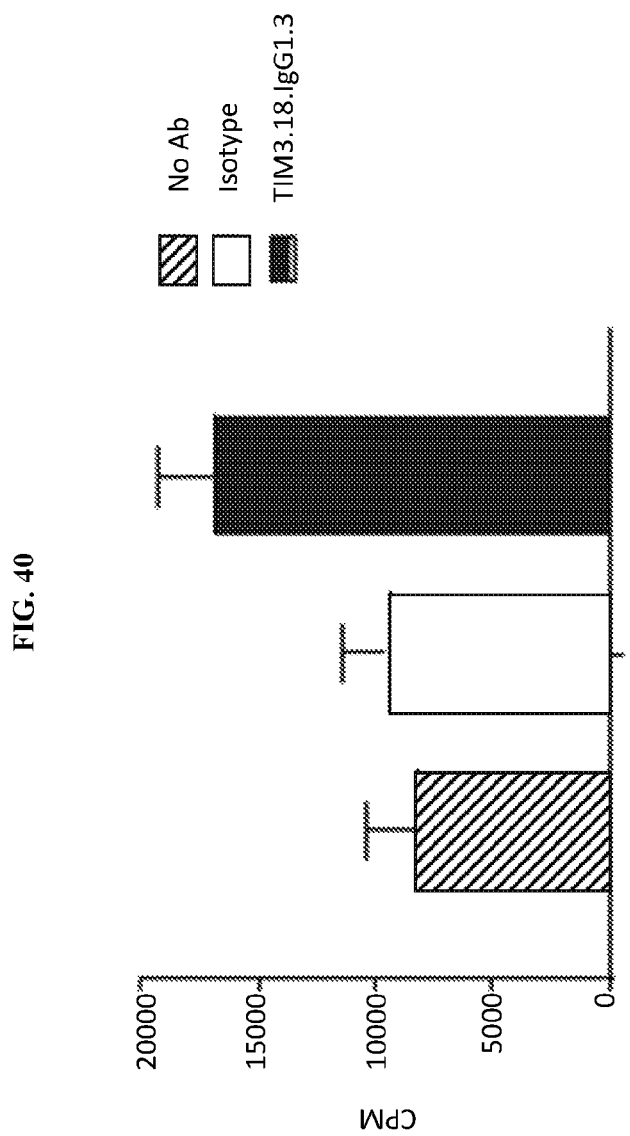

FIG. 39 shows a histogram of the CD163, CD206, and TIM3 expression on the M0 macrophages that were used in an AlloMLR (mixed lymphocyte reaction) assay, the results of which are shown in FIG. 40. Each of the histograms shows the fluorescence intensity of (1) CD163, CD206, or TIM3, (2) isotype control antibody (i.e., negative control), and (3) background fluorescence ("unstained") (i.e., negative control).

FIG. 40 shows the proliferation of cells in an AlloMLR assay conducted in the presence of the anti-TIM3 antibody TIM3.18.IgG1.3, an isotype control, or in the absence of antibody.

Figure 41:

FIG. 41 is a ribbon diagram of the structure of a TIM3: TIM3.18 Fab complex, as determined by crystallography. The Fab fragment is shown in light gray and TIM3 is shown in dark gray.

Figure 42:

FIG. 42 shows the structure of TIM3:TIM3.18 Fab complex, as determined by crystallography. The Fab fragment is shown as a ribbon diagram. TIM3 is shown in white surface representation, with the Fab contact residues depicted in dark gray.

Figure 43:
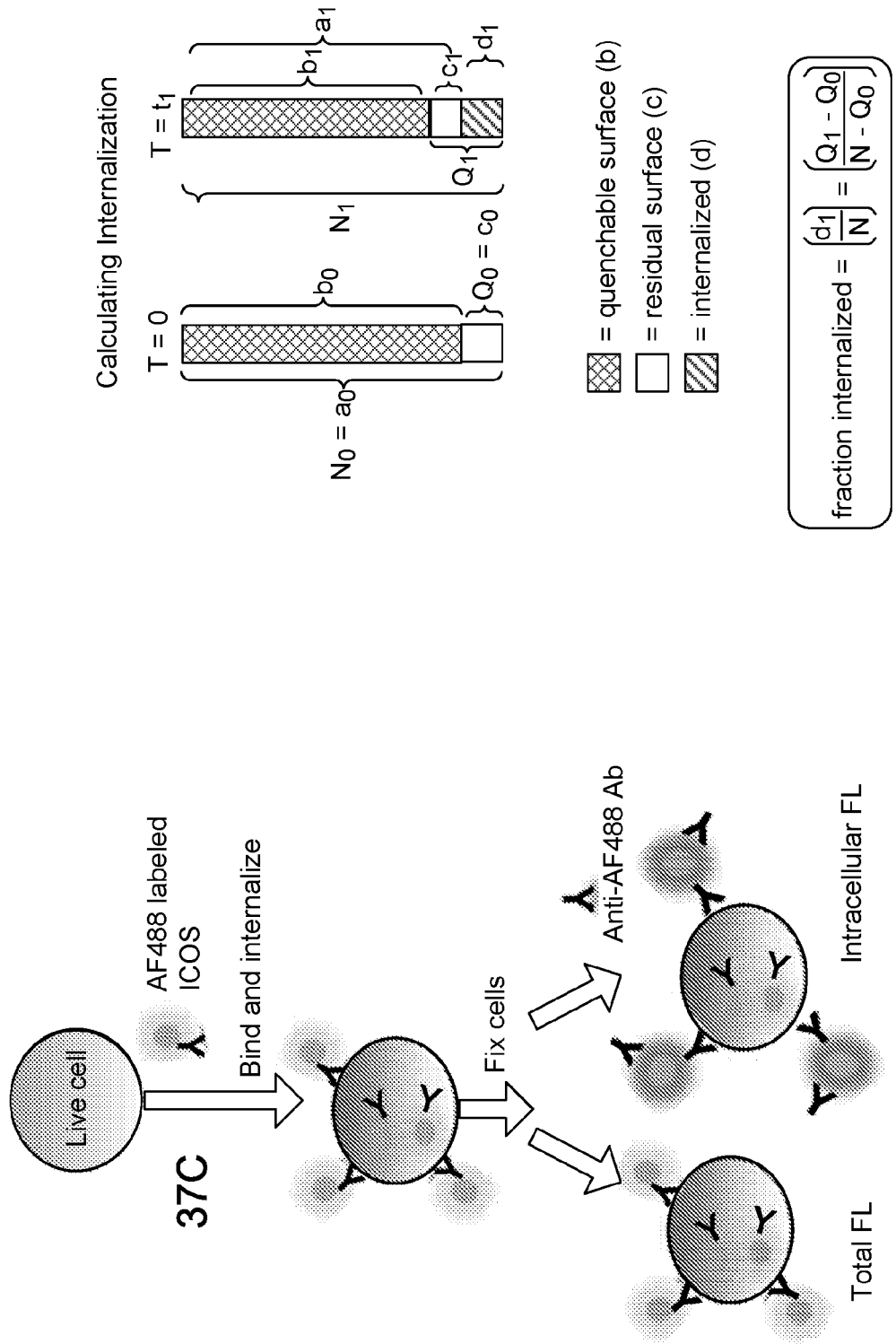

FIG. 43 is a diagram of the assay that was used to measure potential internalization by anti-TIM3 antibodies. The left panel provides a schematic overview of the assay. The right panel describes the calculation of the internalization values.

Figure 44:
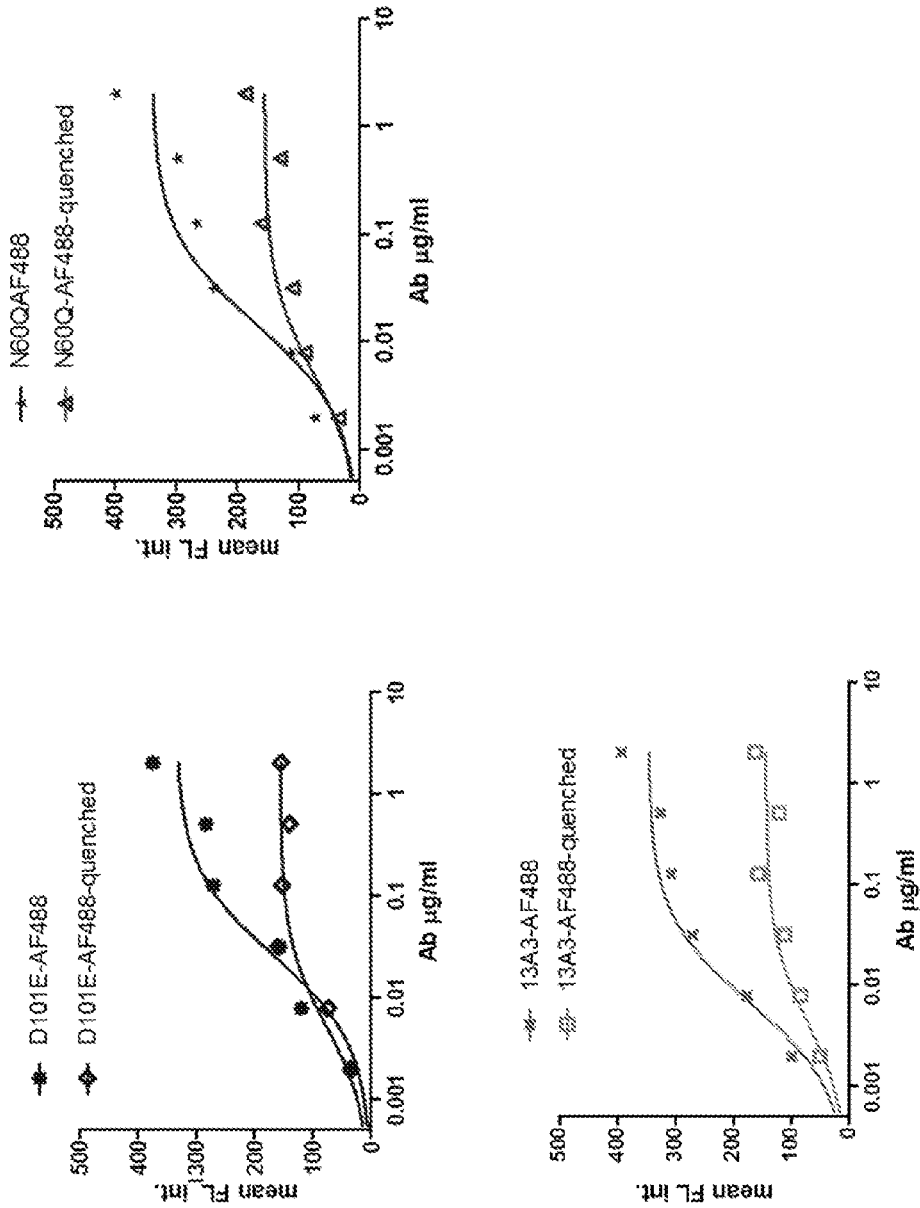

FIG. 44 shows that anti-TIM3 antibodies 13A3 (bottom left panel) and certain variants (D101E—top left panel; N60Q—top right panel) thereof do not trigger receptor (i.e., TIM3) mediated internalization.

Figure 45A:
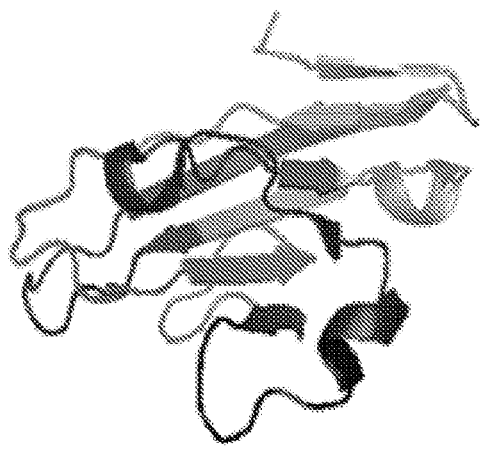
Figure 45B:

FIGS. 45A and 45B show a ribbon diagram depicting the epitopes of anti-TIM3 antibodies 13A3 (FIG. 45A) and 3G4 (FIG. 45B). The amino acid sequences of the epitopes for each of the antibodies are provided below the ribbon diagram. The different patterns identify the specific regions of the anti-TIM3 antibodies that correspond to the specific epitopes. The amino acid sequences shown in FIG. 45A are VPVCWGKGACPVFE (SEQ ID NO: 367) and RIQIPGIMNDEKFNLKL (SEQ ID NO: 368). The amino acid sequences shown in FIG. 45B are YTPAAPGNLVPVCWGKGAC (SEQ ID NO: 478), VPVCWGKGACPVFE (SEQ ID NO: 367), VVVLRTDERDVNY (SEQ ID NO: 479), WTSRYWLNGDFRKGDVSL (SEQ ID NO: 371), and RIQIPGIMNDEKFNLKL (SEQ ID NO: 368).

DETAILED DESCRIPTION OF DISCLOSURE

In order that the present description can be more readily understood, certain terms are first defined. Additional definitions are set forth throughout the detailed description.

It is to be noted that the term "a" or "an" entity refers to one or more of that entity; for example, "a nucleotide sequence," is understood to represent one or more nucleotide sequences. As such, the terms "a" (or "an"), "one or more," and "at least one" can be used interchangeably herein.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

It is understood that wherever aspects are described herein with the language "comprising," otherwise analogous aspects described in terms of "consisting of" and/or "consisting essentially of" are also provided.

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Units, prefixes, and symbols are denoted in their Système International de Unites (SI) accepted form. Numeric ranges are inclusive of the numbers defining the range. Unless otherwise indicated, nucleotide sequences are written left to right in 5' to 3' orientation. Amino acid sequences are written left to right in amino to carboxy orientation. The headings provided herein are not limitations of the various aspects of the disclosure, which can be had by reference to the specification as a whole. Accordingly, the terms defined immediately below are more fully defined by reference to the specification in its entirety.

The term "about" is used herein to mean approximately, roughly, around, or in the regions of. When the term "about" is used in conjunction with a numerical range, it modifies that range by extending the boundaries above and below the numerical values set forth. In general, the term "about" can modify a numerical value above and below the stated value by a variance of, e.g., 10 percent, up or down (higher or lower).

The term "T-cell immunoglobulin and mucin-domain containing-3" or "TIM3" as used herein refers to a receptor that is a member of the T cell immunoglobulin and mucin domain (TIM) family of proteins. Primary ligand for TIM3 include phosphatidylserine (TIM3-L). TIM3 is also referred to as hepatitis A virus cellular receptor 2 (HAVCR2), T-cell immunoglobulin mucin receptor 3, TIM-3, TIMD3, TIMD-3, Kidney Injury Molecule-3, KIM-3, and CD366. The term "TIM3" includes any variants or isoforms of TIM3 which are naturally expressed by cells. Accordingly, antibodies described herein can cross-react with TIM3 from species other than human (e.g., cynomolgus TIM3). Alternatively, the antibodies can be specific for human TIM3 and do not exhibit any cross-reactivity with other species. TIM3 or any variants and isoforms thereof, can either be isolated from cells or tissues which naturally express them or be recombinantly produced using well-known techniques in the art and/or those described herein.

Two isoforms of human TIM3 have been identified. Isoform 1 (Accession No. NP_116171; SEQ ID NO: 286) consists of 301 amino acids and represents the canonical sequence. Isoform 2 (Accession No. AAH20843; SEQ ID NO: 287) consists of 142 amino acids, and is soluble. It lacks amino acid residues 143-301, which encode the transmembrane domain, the cytoplasmic domain, and part of the extracellular domain of TIM3. The amino acid residues 132-142 also differ from the canonical sequence described above.

Below are the amino acid sequences of the two known human TIM3 isoforms.

(A) Human TIM3 isoform 1 (Accession No. NP_116171; SEQ ID NO: 286; encoded by the nucleotide sequence having Accession No. NM_032782.4; SEQ ID NO: 288; FIG. 25):

MFSHLPFDCVLLLLLLLLTRSSEVEYRAEVGQNAYLPCFYTPAAPGNLVP

VCWGKGACPVFECGNVVLRTDERDVNYWTSRYWLNGDFRKGDVSLTIENV

TLADSGIYCCRIQIPGIMNDEKFNLKLVIKPAKVTPAPTRQRDFTAAFPR

MLTTRGHGPAETQTLGSLPDINLTQISTLANELRDSRLANDLRDSGATIR

-continued

IGIYIGAGICAGLALALIFGALIFKWYSHSKEKIQNLSLISLANLPPSGL

ANAVAEGIRSEENIYTIEENVYEVEEPNEYYCYVSSRQQPSQPLGCRFAM

P (B) Human TIM3 isoform 2 (Accession No.
AAH20843; SEQ ID NO: 287; encoded by
the nucleotide sequence having Accession
No. BC020843.1; SEQ ID NO: 289):
MFSHLPFDCVLLLLLLLLTRSSEVEYRAEVGQNAYLPCFYTPAAPGNLVP

VCWGKGACPVFECGNVVLRTDERDVNYWTSRYWLNGDFRKGDVSLTIENV

TLADSGIYCCRIQIPGIMNDEKFNLKLVIKPGEWTFACHLYE

The signal sequence of isoforms 1 and 2 corresponds to amino acids 1-21 (underlined). Thus, the mature isoforms 1 and 2 consist of amino acids 22 to 301 or 142, respectively. The extracellular domain of mature human TIM3 consists of amino acids 22-202 of SEQ ID NO: 286 and has the amino acid sequence:

(SEQ ID NO: 290)
SEVEYRAEVGQNAYLPCFYTPAAPGNLVPVCWGKGACPVFECGNVVLRTD

ERDVNYWTSRYWLNGDFRKGDVSLTIENVTLADSGIYCCRIQIPGIMNDE

KFNLKLVIKPAKVTPAPTRQRDFTAAFPRMLTTRGHGPAETQTLGSLPDI

NLTQISTLANELRDSRLANDLRDSGATIRIG.

Cynomolgus TIM3 protein consists of the following amino acid sequence (including a signal sequence):

(SEQ ID NO: 360)
MFSHLPFDCVLLLLLLLLTRSSEVEYIAEVGQNAYLPCSYTPAPPGNLVP

VCWGKGACPVFDCSNVVLRTENRDVNDRTSGRYWLKGDFHKGDVSLTIEN

VTLADSGVYCCRIQIPGIMNDEKHNLKLVVIKPAKVTPAPTLQRDLTSAF

PRMLTTGEHGPAETQTPGSLPDVNLTQIFTLTNELRDSGATIRTAIYIAA

GISAGLALALIFGALIFKWYSHSKEKTQNLSLISLANIPPSGLANAVAEG

IRSEENIYTIEEDVYEVEEPNEYYCYVSSGQQPSQPLGCRFAMP

The term "antibody" refers, in some embodiments, to a protein comprising at least two heavy (H) chains and two light (L) chains inter-connected by disulfide bonds. Each heavy chain is comprised of a heavy chain variable region (abbreviated herein as VH) and a heavy chain constant region (abbreviated herein as CH). In some antibodies, e.g., naturally-occurring IgG antibodies, the heavy chain constant region is comprised of a hinge and three domains, CH1, CH2 and CH3. In some antibodies, e.g., naturally-occurring IgG antibodies, each light chain is comprised of a light chain variable region (abbreviated herein as VL) and a light chain constant region. The light chain constant region is comprised of one domain (abbreviated herein as CL). The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, and FR4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (C1q) of the classical complement system. A heavy chain may have the C-terminal lysine or not. Unless specified otherwise herein, the amino acids in the variable regions are numbered using the Kabat numbering system and those in the constant regions are numbered using the EU system.

An "IgG antibody", e.g., a human IgG1, IgG2, IgG3 and IgG4 antibody, as used herein has, in some embodiments, the structure of a naturally-occurring IgG antibody, i.e., it has the same number of heavy and light chains and disulfide bonds as a naturally-occurring IgG antibody of the same subclass. For example, an anti-TIM3 IgG1, IgG2, IgG3 or IgG4 antibody consists of two heavy chains (HCs) and two light chains (LCs), wherein the two HCs and LCs are linked by the same number and location of disulfide bridges that occur in naturally-occurring IgG1, IgG2, IgG3 and IgG4 antibodies, respectively (unless the antibody has been mutated to modify the disulfide bridges).

Antibodies typically bind specifically to their cognate antigen with high affinity, reflected by a dissociation constant ($K_D$) of $10^{-5}$ to $10^{-11}$ M or less. Any $K_D$ greater than about $10^{-4}$ M is generally considered to indicate nonspecific binding. As used herein, an antibody that "binds specifically" to an antigen refers to an antibody that binds to the antigen and substantially identical antigens with high affinity, which means having a $K_D$ of $10^{-7}$ M or less, $10^{-8}$ M or less, $5 \times 10^{-9}$ M or less, or between $10^{-8}$ M and $10^{-10}$ M or less, but does not bind with high affinity to unrelated antigens. An antigen is "substantially identical" to a given antigen if it exhibits a high degree of sequence identity to the given antigen, for example, if it exhibits at least 80%, at least 90%, at least 95%, at least 97%, or at least 99% sequence identity to the sequence of the given antigen. By way of example, an antibody that binds specifically to human TIM3 can, in some embodiments, also have cross-reactivity with TIM3 antigens from certain primate species (e.g., cynomolgus TIM3), but cannot cross-react with TIM3 antigens from other species or with an antigen other than TIM3.

An immunoglobulin can be from any of the commonly known isotypes, including but not limited to IgA, secretory IgA, IgG and IgM. The IgG isotype is divided in subclasses in certain species: IgG1, IgG2, IgG3 and IgG4 in humans, and IgG1, IgG2a, IgG2b and IgG3 in mice. In some embodiments, the anti-TIM3 antibodies described herein are of the IgG1 subtype. Immunoglobulins, e.g., IgG1, exist in several allotypes, which differ from each other in at most a few amino acids. "Antibody" includes, by way of example, both naturally-occurring and non-naturally-occurring antibodies; monoclonal and polyclonal antibodies; chimeric and humanized antibodies; human and nonhuman antibodies and wholly synthetic antibodies.

The term "antigen binding portion" of an antibody, as used herein, refers to one or more fragments of an antibody that retain the ability to specifically bind to an antigen (e.g., human TIM3). It has been shown that the antigen-binding function of an antibody can be performed by fragments of a full-length antibody. Examples of binding fragments encompassed within the term "antigen binding portion" of an antibody, e.g., an anti-TIM3 antibody described herein, include (i) a Fab fragment (fragment from papain cleavage) or a similar monovalent fragment consisting of the $V_L$, $V_H$, LC and CH1 domains; (ii) a F(ab')2 fragment (fragment from pepsin cleavage) or a similar bivalent fragment comprising two Fab fragments linked by a disulfide bridge at the hinge region; (iii) a Fd fragment consisting of the $V_H$ and CH1 domains; (iv) a Fv fragment consisting of the $V_L$ and $V_H$ domains of a single arm of an antibody, (v) a dAb fragment (Ward et al., (1989) *Nature* 341:544-546), which consists of a $V_H$ domain; (vi) an isolated complementarity determining region (CDR) and (vii) a combination of two or more isolated CDRs which can optionally be joined by a synthetic linker. Furthermore, although the two domains of the Fv fragment, $V_L$ and $V_H$, are coded for by separate genes, they can be joined, using recombinant methods, by a synthetic linker that enables them to be made as a single protein chain in which the $V_L$ and $V_H$ regions pair to form monovalent molecules (known as single chain Fv (scFv); see, e.g., Bird et al. (1988) *Science* 242:423-426; and Huston et al. (1988) *Proc. Natl. Acad. Sci. USA* 85:5879-5883). Such single chain antibodies are also intended to be encompassed within the term "antigen binding portion" of an antibody. These antibody fragments are obtained using conventional techniques known to those with skill in the art, and the fragments are screened for utility in the same manner as are intact antibodies. Antigen binding portions can be produced by recombinant DNA techniques, or by enzymatic or chemical cleavage of intact immunoglobulins.

A "bispecific" or "bifunctional antibody" is an artificial hybrid antibody having two different heavy/light chain pairs and two different binding sites. Bispecific antibodies can be produced by a variety of methods including fusion of hybridomas or linking of Fab' fragments. See, e.g., Songsivilai & Lachmann, *Clin. Exp. Immunol.* 79:315-321 (1990); Kostelny et al., *J. Immunol.* 148, 1547-1553 (1992).

The term "monoclonal antibody," as used herein, refers to an antibody from a population of substantially homogeneous antibodies, i.e., the individual antibodies comprised in the population are substantially similar and bind the same epitope(s) (e.g., the antibodies display a single binding specificity and affinity), except for possible variants that may arise during production of the monoclonal antibody, such variants generally being present in minor amounts. The modifier "monoclonal" indicates the character of the antibody as being obtained from a substantially homogeneous population of antibodies, and is not to be construed as requiring production of the antibody by any particular method. The term "human monoclonal antibody" refers to an antibody from a population of substantially homogeneous antibodies that display(s) a single binding specificity and which has variable and optional constant regions derived from human germline immunoglobulin sequences. In some embodiments, human monoclonal antibodies are produced by a hybridoma which includes a B cell obtained from a transgenic non-human animal, e.g., a transgenic mouse, having a genome comprising a human heavy chain transgene and a light chain transgene fused to an immortalized cell.

The term "recombinant human antibody," as used herein, includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom, (b) antibodies isolated from a host cell transformed to express the antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies comprise variable and constant regions that utilize particular human germline immunoglobulin sequences are encoded by the germline genes, but include subsequent rearrangements and mutations which occur, for example, during antibody maturation. As known in the art (see, e.g., Lonberg (2005) *Nature Biotech.* 23(9): 1117-1125), the variable region contains the antigen binding domain, which is encoded by various genes that rearrange to form an antibody specific for a foreign antigen. In addition to rearrangement, the variable region can be further modified by multiple single amino acid changes (referred to as somatic mutation or hypermutation) to increase the affinity of the antibody to the foreign antigen. The constant region will change in further response to an antigen (i.e., isotype switch). Therefore, the rearranged and somatically mutated nucleic acid molecules that encode the light chain and heavy chain immunoglobulin polypeptides in response to an antigen cannot have sequence identity with the original nucleic acid molecules, but instead will be substantially identical or similar (i.e., have at least 80% identity).

A "human" antibody (HuMAb) refers to an antibody having variable regions in which both the framework and CDR regions are derived from human germline immunoglobulin sequences. Furthermore, if the antibody contains a constant region, the constant region also is derived from human germline immunoglobulin sequences. The anti-TIM3 antibodies described herein can include amino acid residues not encoded by human germline immunoglobulin sequences (e.g., mutations introduced by random or site-specific mutagenesis in vitro or by somatic mutation in vivo). However, the term "human antibody", as used herein, is not intended to include antibodies in which CDR sequences derived from the germline of another mammalian species, such as a mouse, have been grafted onto human framework sequences. The terms "human" antibodies and "fully human" antibodies are used synonymously.

A "humanized" antibody refers to an antibody in which some, most or all of the amino acids outside the CDR domains of a non-human antibody are replaced with corresponding amino acids derived from human immunoglobulins. In some embodiments of a humanized form of an antibody, some, most or all of the amino acids outside the CDR domains have been replaced with amino acids from human immunoglobulins, whereas some, most or all amino acids within one or more CDR regions are unchanged. Small additions, deletions, insertions, substitutions or modifications of amino acids are permissible as long as they do not abrogate the ability of the antibody to bind to a particular antigen. A "humanized" antibody retains an antigenic specificity similar to that of the original antibody.

A "chimeric antibody" refers to an antibody in which the variable regions are derived from one species and the constant regions are derived from another species, such as an antibody in which the variable regions are derived from a mouse antibody and the constant regions are derived from a human antibody.

As used herein, "isotype" refers to the antibody class (e.g., IgG1, IgG2, IgG3, IgG4, IgM, IgA1, IgA2, IgD, and IgE antibody) that is encoded by the heavy chain constant region genes.

"Allotype" refers to naturally-occurring variants within a specific isotype group, which variants differ in a few amino acids (see, e.g., Jefferis et al. (2009) *mAbs* 1:1). Anti-TIM3 antibodies described herein can be of any allotype. As used herein, antibodies referred to as "IgG1f," "IgG1.1f," or "IgG1.3f" isotype are IgG1, effectorless IgG1.1, and effectorless IgG1.3 antibodies, respectively, of the allotype "f," i.e., having 214R, 356E and 358M according to the EU index as in Kabat, as shown, e.g., in SEQ ID NO: 3.

The phrases "an antibody recognizing an antigen" and "an antibody specific for an antigen" are used interchangeably herein with the term "an antibody which binds specifically to an antigen."

An "isolated antibody," as used herein, is intended to refer to an antibody which is substantially free of other proteins and cellular material.

As used herein, an antibody that "inhibits binding of TIM3-L to TIM3" is intended to refer to an antibody that inhibits the binding of TIM3 to its ligand, e.g., phosphatidylserine, e.g., in binding assays using CHO cells transfected with human TIM3 or TIM3 expressing activated T cells, with an $EC_{50}$ of about 1 µg/mL or less, such as about 0.9 µg/mL or less, about 0.85 µg/mL or less, about 0.8 µg/mL or less, about 0.75 µg/mL or less, about 0.7 µg/mL or less, about 0.65 µg/mL or less, about 0.6 µg/mL or less, about 0.55 µg/mL or less, about 0.5 µg/mL or less, about 0.45 µg/mL or less, about 0.4 µg/mL or less, about 0.35 µg/mL or less, about 0.3 pg/mL or less, about 0.25 µg/mL or less, about 0.2 µg/mL or less, about 0.15 µg/mL or less, about 0.1 µg/mL or less, or about 0.05 µg/mL or less, in art-recognized methods, e.g., the FACS-based binding assays described herein.

An "effector function" refers to the interaction of an antibody Fc region with an Fc receptor or ligand, or a biochemical event that results therefrom. Exemplary "effector functions" include C1q binding, complement dependent cytotoxicity (CDC), Fc receptor binding, FcγR-mediated effector functions such as ADCC and antibody dependent cell-mediated phagocytosis (ADCP), and downregulation of a cell surface receptor (e.g., the B cell receptor, BCR). Such effector functions generally require the Fc region to be combined with a binding domain (e.g., an antibody variable domain).

An "Fc receptor" or "FcR" is a receptor that binds to the Fc region of an immunoglobulin. FcRs that bind to an IgG antibody comprise receptors of the FcγR family, including allelic variants and alternatively spliced forms of these receptors. The FcγR family consists of three activating (FcγRI, FcγRIII, and FcγRIV in mice; FcγRIA, FcγRIIA, and FcγRIIIA in humans) and one inhibitory (FcγRIIB) receptor. Various properties of human FcγRs are known in the art. The majority of innate effector cell types coexpress one or more activating FcγR and the inhibitory FcγRIIB, whereas natural killer (NK) cells selectively express one activating Fc receptor (FcγRIII in mice and FcγRIIIA in humans) but not the inhibitory FcγRIIB in mice and humans. Human IgG1 binds to most human Fc receptors and is considered equivalent to murine IgG2a with respect to the types of activating Fc receptors that it binds to.

An "Fc region" (fragment crystallizable region) or "Fc domain" or "Fc" refers to the C-terminal region of the heavy chain of an antibody that mediates the binding of the immunoglobulin to host tissues or factors, including binding to Fc receptors located on various cells of the immune system (e.g., effector cells) or to the first component (C1q) of the classical complement system. Thus, an Fc region comprises the constant region of an antibody excluding the first constant region immunoglobulin domain (e.g., CH1 or CL). In IgG, IgA and IgD antibody isotypes, the Fc region comprises two identical protein fragments, derived from the second (CH2) and third (CH3) constant domains of the antibody's two heavy chains; IgM and IgE Fc regions comprise three heavy chain constant domains (CH domains 24) in each polypeptide chain. For IgG, the Fc region comprises immunoglobulin domains CH2 and CH3 and the hinge between CH1 and CH2 domains. Although the definition of the boundaries of the Fc region of an immunoglobulin heavy chain might vary, as defined herein, the human IgG heavy chain Fc region is defined to stretch from an amino acid residue D221 for IgG1, V222 for IgG2, L221 for IgG3 and P224 for IgG4 to the carboxy-terminus of the heavy chain, wherein the numbering is according to the EU index as in Kabat. The CH2 domain of a human IgG Fc region extends from amino acid 237 to amino acid 340, and the CH3 domain is positioned on C-terminal side of a CH2 domain in an Fc region, i.e., it extends from amino acid 341 to amino acid 447 or 446 (if the C-terminal lysine residue is absent) or 445 (if the C-terminal glycine and lysine residues are absent) of an IgG. As used herein, the Fc region can be a native sequence Fc, including any allotypic variant, or a variant Fc (e.g., a non-naturally-occurring Fc). Fc can also refer to this region in isolation or in the context of an Fc-comprising protein polypeptide such as a "binding protein comprising an Fc region," also referred to as an "Fc fusion protein" (e.g., an antibody or immunoadhesion).

A "native sequence Fc region" or "native sequence Fc" comprises an amino acid sequence that is identical to the amino acid sequence of an Fc region found in nature. Native sequence human Fc regions include a native sequence human IgG1 Fc region; native sequence human IgG2 Fc region; native sequence human IgG3 Fc region; and native sequence human IgG4 Fc region as well as naturally-occurring variants thereof. Native sequence Fc include the various allotypes of Fcs (see, e.g., Jefferis et al. (2009) *mAbs* 1: 1).

The term "epitope" or "antigenic determinant" refers to a site on an antigen (e.g., TIM3) to which an immunoglobulin or antibody specifically binds, e.g., as defined by the specific method used to identify it. Epitopes can be formed both from contiguous amino acids (usually a linear epitope) or non-contiguous amino acids juxtaposed by tertiary folding of a protein (usually a conformational epitope). Epitopes formed from contiguous amino acids are typically, but not always, retained on exposure to denaturing solvents, whereas epitopes formed by tertiary folding are typically lost on treatment with denaturing solvents. An epitope typically includes at least 3, 4, 5, 6, 7, 8, 9, 10, 11, 12, 13, 14 or 15 amino acids in a unique spatial conformation. Methods for determining what epitopes are bound by a given antibody (i.e., epitope mapping) are well known in the art and include, for example, immunoblotting and immunoprecipitation assays, wherein overlapping or contiguous peptides from (e.g., from TIM3) are tested for reactivity with a given antibody (e.g., anti-TIM3 antibody). Methods of determining spatial conformation of epitopes include techniques in the art and those described herein, for example, x-ray crystallography, antigen mutational analysis, 2-dimensional nuclear magnetic resonance and HDX-MS (see, e.g., Epitope Mapping Protocols in Methods in Molecular Biology, Vol. 66, G. E. Morris, Ed. (1996)).

The term "epitope mapping" refers to the process of identification of the molecular determinants for antibody-antigen recognition.

The term "binds to the same epitope" with reference to two or more antibodies means that the antibodies bind to the same segment of amino acid residues, as determined by a given method. Techniques for determining whether antibodies bind to the "same epitope on TIM3" with the antibodies described herein include, for example, epitope mapping methods, such as, x-ray analyses of crystals of antigen:antibody complexes which provides atomic resolution of the epitope and hydrogen/deuterium exchange mass spectrometry (HDX-MS). Other methods monitor the binding of the antibody to antigen fragments or mutated variations of the antigen where loss of binding due to a modification of an amino acid residue within the antigen sequence is often considered an indication of an epitope component. In addition, computational combinatorial methods for epitope mapping can also be used. These methods rely on the ability of the antibody of interest to affinity isolate specific short peptides from combinatorial phage display peptide libraries. Antibodies having the same VH and VL or the same CDR1, 2 and 3 sequences are expected to bind to the same epitope.

Antibodies that "compete with another antibody for binding to a target" refer to antibodies that inhibit (partially or completely) the binding of the other antibody to the target. Whether two antibodies compete with each other for binding to a target, i.e., whether and to what extent one antibody inhibits the binding of the other antibody to a target, can be determined using known competition experiments, e.g., BIACORE® surface plasmon resonance (SPR) analysis. In some embodiments, an antibody competes with, and inhibits binding of another antibody to a target by at least 50%, 60%, 70%, 80%, 90% or 100%. The level of inhibition or competition can be different depending on which antibody is the "blocking antibody" (i.e., the cold antibody that is incubated first with the target). Competition assays can be conducted as described, for example, in Ed Harlow and David Lane, Cold Spring Harb Protoc; 2006; doi: 10.1101/p:b.prot4277 or in Chapter 11 of "Using Antibodies" by Ed Harlow and David Lane, Cold Spring Harbor Laboratory Press, Cold Spring Harbor, NY, USA 1999. Two antibodies "cross-compete" if antibodies block each other both ways by at least 50%, i.e., regardless of whether one or the other antibody is contacted first with the antigen in the competition experiment.

Competitive binding assays for determining whether two antibodies compete or cross-compete for binding include: competition for binding to T cells expressing TIM3, e.g., by flow cytometry, such as described in the Examples. Other methods include: SPR (e.g., BIACORE®), solid phase direct or indirect radioimmunoassay (RIA), solid phase direct or indirect enzyme immunoassay (EIA), sandwich competition assay (see Stahli et al., *Methods in Enzymology* 9:242 (1983)); solid phase direct biotin-avidin EIA (see Kirkland et al., *J. Immunol.* 137:3614 (1986)); solid phase direct labeled assay, solid phase direct labeled sandwich assay (see Harlow and Lane, Antibodies: A Laboratory Manual, Cold Spring Harbor Press (1988)); solid phase direct label RIA using 1-125 label (see Morel et al., *Mol. Immunol.* 25(1):7 (1988)); solid phase direct biotin-avidin EIA (Cheung et al., *Virology* 176:546 (1990)); and direct labeled RIA. (Moldenhauer et al., *Scand. J. Immunol.* 32:77 (1990)).

As used herein, the terms "specific binding," "selective binding," "selectively binds," and "specifically binds," refer to antibody binding to an epitope on a predetermined antigen. Typically, the antibody (i) binds with an equilibrium dissociation constant ($K_D$) of approximately less than $10^{-7}$ M, such as approximately less than $10^{-8}$ M, $10^{-9}$ M or $10^{-10}$ M or even lower when determined by, e.g., surface plasmon resonance (SPR) technology in a BIACORE® 2000 instrument using the predetermined antigen, e.g., recombinant human TIM3, as the analyte and the antibody as the ligand, or Scatchard analysis of binding of the antibody to antigen positive cells, and (ii) binds to the predetermined antigen with an affinity that is at least two-fold greater than its affinity for binding to a non-specific antigen (e.g., BSA, casein) other than the predetermined antigen or a closely-related antigen. Accordingly, an antibody that "specifically binds to human TIM3" refers to an antibody that binds to soluble or cell bound human TIM3 with a $K_D$ of $10^{-7}$ M or less, such as approximately less than $10^{-8}$ M, $10^{-9}$ M or $10^{-10}$ M or even lower. An antibody that "cross-reacts with cynomolgus TIM3" refers to an antibody that binds to cynomolgus TIM3 with a $K_D$ of $10^{-7}$ M or less, such as approximately less than $10^{-8}$ M, $10^{-9}$ M or $10^{-10}$ M or even lower. In some embodiments, such antibodies that do not cross-react with TIM3 from a non-human species exhibit essentially undetectable binding against these proteins in standard binding assays.

The term "$k_{assoc}$" or "$k_a$", as used herein, is intended to refer to the association rate of a particular antibody-antigen interaction, whereas the term "$k_{dis}$" or "$k_d$," as used herein, is intended to refer to the dissociation rate of a particular antibody-antigen interaction. The term "$K_D$", as used herein, is intended to refer to the dissociation constant, which is obtained from the ratio of $k_d$ to k, (i.e., $k_d/k_a$) and is expressed as a molar concentration (M). $K_D$ values for antibodies can be determined using methods well established in the art Available methods for determining the $K_D$ of an antibody include surface plasmon resonance, a biosensor system such as a BIACORE® system or flow cytometry and Scatchard analysis.

As used herein, the term "high affinity" for an IgG antibody refers to an antibody having a $K_D$ of $10^{-8}$ M or less, $10^{-9}$ M or less, or $10^{-10}$ M or less for a target antigen. However, "high affinity" binding can vary for other antibody isotypes. For example, "high affinity" binding for an IgM isotype refers to an antibody having a $K_D$ of $10^{-10}$ M or less, or $10^8$ M or less.

The term "$EC_{50}$" in the context of an in vitro or in vivo assay using an antibody or antigen binding fragment thereof, refers to the concentration of an antibody or an antigen-binding portion thereof that induces a response that is 50% of the maximal response, i.e., halfway between the maximal response and the baseline.

The term "naturally-occurring" as used herein as applied to an object refers to the fact that an object can be found in nature. For example, a polypeptide or polynucleotide sequence that is present in an organism (including viruses) that can be isolated from a source in nature and which has not been intentionally modified by man in the laboratory is naturally-occurring.

A "polypeptide" refers to a chain comprising at least two consecutively linked amino acid residues, with no upper limit on the length of the chain. One or more amino acid residues in the protein can contain a modification such as, but not limited to, glycosylation, phosphorylation or disulfide bond formation. A "protein" can comprise one or more polypeptides.

The term "nucleic acid molecule," as used herein, is intended to include DNA molecules and RNA molecules. A nucleic acid molecule can be single-stranded or double-stranded, and can be cDNA.

"Conservative amino acid substitutions" refer to substitutions of an amino acid residue with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). In some embodiments, a predicted nonessential amino acid residue in an anti-TIM3 antibody is replaced with another amino acid residue from the same side chain family. Methods of identifying nucleotide and amino acid conservative substitutions which do not eliminate antigen binding are well-known in the art (see, e.g., Brummell et al., *Biochem.* 32: 1180-1187 (1993); Kobayashi et al. *Protein Eng.* 12(10):879-884 (1999); and Burks et al. *Proc. Natl. Acad. Sci. USA* 94:412-417 (1997)).

For nucleic acids, the term "substantial homology" indicates that two nucleic acids, or designated sequences thereof, when optimally aligned and compared, are identical, with appropriate nucleotide insertions or deletions, in at least about 80% of the nucleotides, at least about 90% to 95%, or at least about 98% to 99.5% of the nucleotides. Alternatively, substantial homology exists when the segments will hybridize under selective hybridization conditions, to the complement of the strand.

For polypeptides, the term "substantial homology" indicates that two polypeptides, or designated sequences thereof, when optimally aligned and compared, are identical, with appropriate amino acid insertions or deletions, in at least about 80% of the amino acids, at least about 90% to 95%, or at least about 98% to 99.5% of the amino acids.

The percent identity between two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two nucleotide sequences can be determined using the GAP program in the GCG software package (available at worldwideweb.gcg.com), using a NWSgapdna.CMP matrix and a gap weight of 40, 50, 60, 70, or 80 and a length weight of 1, 2, 3, 4, 5, or 6. The percent identity between two nucleotide or amino acid sequences can also be determined using the algorithm of E. Meyers and W. Miller (*CABIOS*, 4: 11-17 (1989)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (*J. Mol. Biol.* (48):444-453 (1970)) algorithm which has been incorporated into the GAP program in the GCG software package (available at gcg.com), using either a Blossum 62 matrix or a PAM250 matrix, and a gap weight of 16, 14, 12, 10, 8, 6, or 4 and a length weight of 1, 2, 3, 4, 5, or 6.

The nucleic acid and protein sequences described herein can further be used as a "query sequence" to perform a search against public databases to, for example, identify related sequences. Such searches can be performed using the NBLAST and XBLAST programs (version 2.0) of Altschul, et al. (1990) *J. Mol. Biol.* 215:403-10. BLAST nucleotide searches can be performed with the NBLAST program, score=100, word length=12 to obtain nucleotide sequences homologous to the nucleic acid molecules described herein. BLAST protein searches can be performed with the XBLAST program, score=50, word length=3 to obtain amino acid sequences homologous to the protein molecules described herein. To obtain gapped alignments for comparison purposes, Gapped BLAST can be utilized as described in Altschul et al., (1997) *Nucleic Acids Res.* 25(17):3389-3402. When utilizing BLAST and Gapped BLAST programs, the default parameters of the respective programs (e.g., XBLAST and NBLAST) can be used. See worldwideweb.ncbi.nlm.nih.gov.

The nucleic acids can be present in whole cells, in a cell lysate, or in a partially purified or substantially pure form. A nucleic acid is "isolated" or "rendered substantially pure" when purified away from other cellular components or other contaminants, e.g., other cellular nucleic acids (e.g., the other parts of the chromosome) or proteins, by standard techniques, including alkaline/SDS treatment, CsCl banding, column chromatography, agarose gel electrophoresis and others well known in the art. See, F. Ausubel, et al., ed. Current Protocols in Molecular Biology, Greene Publishing and Wiley Interscience, New York (1987).

Nucleic acids, e.g., cDNA, can be mutated, in accordance with standard techniques to provide gene sequences. For coding sequences, these mutations, can affect amino acid sequence as desired. In particular, DNA sequences substantially homologous to or derived from native V, D, J, constant, switches and other such sequences described herein are contemplated (where "derived" indicates that a sequence is identical or modified from another sequence).

The term "vector," as used herein, is intended to refer to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors") In general, expression vectors of utility in recombinant DNA techniques are often in the form of plasmids. In the present specification, "plasmid" and "vector" can be used interchangeably as the plasmid is the most commonly used form of vector. However, also included are other forms of expression vectors, such as viral vectors (e.g., replication defective retroviruses, adenoviruses and adeno-associated viruses), which serve equivalent functions.

The term "recombinant host cell" (or simply "host cell"), as used herein, is intended to refer to a cell that comprises a nucleic acid that is not naturally present in the cell, and can be a cell into which a recombinant expression vector has been introduced. It should be understood that such terms are intended to refer not only to the particular subject cell but to the progeny of such a cell. Because certain modifications can occur in succeeding generations due to either mutation or environmental influences, such progeny cannot, in fact, be identical to the parent cell, but are still included within the scope of the term "host cell" as used herein.

An "immune response" is as understood in the art, and generally refers to a biological response within a vertebrate against foreign agents or abnormal, e.g., cancerous cells, which response protects the organism against these agents and diseases caused by them. An immune response is mediated by the action of one or more cells of the immune system (for example, a T lymphocyte, B lymphocyte, natural killer (NK) cell, macrophage, eosinophil, mast cell, dendritic cell or neutrophil) and soluble macromolecules produced by any of these cells or the liver (including antibodies, cytokines, and complement) that results in selective targeting, binding to, damage to, destruction of, and/or elimination from the vertebrate's body of invading pathogens, cells or tissues infected with pathogens, cancerous or other abnormal cells, or, in cases of autoimmunity or pathological inflammation, normal human cells or tissues. An immune reaction includes, e.g., activation or inhibition of a T cell, e.g., an effector T cell, a Th cell, a CD4+ cell, a CD8+ T cell, or a Treg cell, or activation or inhibition of any other cell of the immune system, e.g., NK cell.

An "immunomodulator" or "immunoregulator" refers to an agent, e.g., an agent targeting a component of a signaling pathway that can be involved in modulating, regulating, or modifying an immune response. "Modulating," "regulating," or "modifying" an immune response refers to any alteration in a cell of the immune system or in the activity of such cell (e.g., an effector T cell, such as a Th1 cell). Such modulation includes stimulation or suppression of the immune system which can be manifested by an increase or decrease in the number of various cell types, an increase or decrease in the activity of these cells, or any other changes which can occur within the immune system. Both inhibitory and stimulatory immunomodulators have been identified, some of which can have enhanced function in a tumor microenvironment. In some embodiments, the immunomodulator targets a molecule on the surface of a T cell. An "immunomodulatory target" or "immunoregulatory target" is a molecule, e.g., a cell surface molecule, that is targeted for binding by, and whose activity is altered by the binding of, a substance, agent, moiety, compound or molecule. Immunomodulatory targets include, for example, receptors on the surface of a cell ("immunomodulatory receptors") and receptor ligands ("immunomodulatory ligands").

"Immunotherapy" refers to the treatment of a subject afflicted with, or at risk of contracting or suffering a recurrence of, a disease by a method comprising inducing, enhancing, suppressing or otherwise modifying the immune system or an immune response.

"Immuno stimulating therapy" or "immuno stimulatory therapy" refers to a therapy that results in increasing (inducing or enhancing) an immune response in a subject for, e.g., treating cancer.

"Potentiating an endogenous immune response" means increasing the effectiveness or potency of an existing immune response in a subject. This increase in effectiveness and potency can be achieved, for example, by overcoming mechanisms that suppress the endogenous host immune response or by stimulating mechanisms that enhance the endogenous host immune response.

"T effector" ("Ta") cells refers to T cells (e.g., CD4+ and CD8+ T cells) with cytolytic activities as well as T helper (Th) cells, e.g., Th1 cells, which cells secrete cytokines and activate and direct other immune cells, but does not include regulatory T cells (Treg cells). Certain anti-TIM3 antibodies described herein activate $T_{eff}$ cells, e.g., CD4+ and CD8+ $T_{eff}$ cells and Th1 cells.

An increased ability to stimulate an immune response or the immune system, can result from an enhanced agonist activity of T cell co-stimulatory receptors and/or an enhanced antagonist activity of inhibitory receptors. An increased ability to stimulate an immune response or the immune system can be reflected by a fold increase of the $EC_{50}$ or maximal level of activity in an assay that measures an immune response, e.g., an assay that measures changes in cytokine or chemokine release, cytolytic activity (determined directly on target cells or indirectly via detecting CD107a or granzymes) and proliferation. The ability to stimulate an immune response or the immune system activity can be enhanced by at least 10%, 30%, 50%, 75%, 2 fold, 3 fold, 5 fold or more.

As used herein, the term "linked" refers to the association of two or more molecules. The linkage can be covalent or non-covalent. The linkage also can be genetic (i.e., recombinantly fused). Such linkages can be achieved using a wide variety of art recognized techniques, such as chemical conjugation and recombinant protein production.

As used herein, "administering" refers to the physical introduction of a composition comprising a therapeutic agent to a subject, using any of the various methods and delivery systems known to those skilled in the art. Different routes of administration for the anti-TIM3 antibodies described herein include intravenous, intraperitoneal, intramuscular, subcutaneous, spinal or other parenteral routes of administration, for example by injection or infusion. The phrase "parenteral administration" as used herein means modes of administration other than enteral and topical administration, usually by injection, and includes, without limitation, intravenous, intraperitoneal, intramuscular, intraarterial, intrathecal, intralymphatic, intralesional, intracapsular, intraorbital, intracardiac, intradermal, transtracheal, subcutaneous, subcuticular, intraarticular, subcapsular, subarachnoid, intraspinal, epidural and intrasternal injection and infusion, as well as in vivo electroporation. Alternatively, an antibody described herein can be administered via a non-parenteral route, such as a topical, epidermal or mucosal route of administration, for example, intranasally, orally, vaginally, rectally, sublingually or topically. Administering can also be performed, for example, once, a plurality of times, and/or over one or more extended periods.

As used herein, the term "T cell-mediated response" refers to a response mediated by T cells, including effector T cells (e.g., CD8+ cells) and helper T cells (e.g., CD4+ cells). T cell mediated responses include, for example, T cell cytotoxicity and proliferation.

As used herein, the term "cytotoxic T lymphocyte (CL) response" refers to an immune response induced by cytotoxic T cells. CTL responses are mediated primarily by CD8+ T cells.

As used herein, the terms "inhibits" or "blocks" (e.g., referring to inhibition/blocking of binding of TIM3-L to TIM3 on cells) are used interchangeably and encompass both partial and complete inhibition/blocking. In some embodiments, the anti-TIM3 antibody inhibits binding of TIM3-L to TIM3 by at least about 50%, for example, about 60%, 70%, 80%, 90%, 95%, 99%, or 100%, determined, e.g., as further described herein. In some embodiments, the anti-TIM3 antibody inhibits binding of TIM3-L to TIM3 by no more than 50%, for example, by about 40%, 30%, 20%, 10%, 5% or 1%, determined, e.g., as further described herein.

As used herein, the phrase "inhibits growth of a tumor" includes any measurable decrease in the growth of a tumor, e.g., the inhibition of growth of a tumor by at least about 10%, for example, at least about 20%, at least about 30%, at least about 40%, at least about 50%, at least about 60%, at least about 70%, at least about 80%, at least about 90%, at least about 99%, or 100%.

As used herein, "cancer" refers a broad group of diseases characterized by the uncontrolled growth of abnormal cells in the body. Unregulated cell division can result in the formation of malignant tumors or cells that invade neighboring tissues and can metastasize to distant parts of the body through the lymphatic system or bloodstream.

The terms "treat," "treating," and "treatment," as used herein, refer to any type of intervention or process performed on, or administering an active agent to, the subject with the objective of reversing, alleviating, ameliorating, inhibiting, or slowing down or preventing the progression, development, severity or recurrence of a symptom, complication, condition or biochemical indicia associated with a disease or enhancing overall survival. Treatment can be of a subject having a disease or a subject who does not have a disease (e.g., for prophylaxis).

A "hematological malignancy" includes a lymphoma, leukemia, myeloma or a lymphoid malignancy, as well as a cancer of the spleen and the lymph nodes. Exemplary lymphomas include both B cell lymphomas (a B-cell hematological cancer) and T cell lymphomas. B-cell lymphomas include both Hodgkin's lymphomas and most non-Hodgkin's lymphomas. Non-limiting examples of B cell lymphomas include diffuse large B-cell lymphoma, follicular lymphoma, mucosa-associated lymphatic tissue lymphoma, small cell lymphocytic lymphoma (overlaps with chronic lymphocytic leukemia), mantle cell lymphoma (MCL), Burkitt's lymphoma, mediastinal large B cell lymphoma, Waldenstrom macroglobulinemia, nodal marginal zone B cell lymphoma, splenic marginal zone lymphoma, intravascular large B-cell lymphoma, primary effusion lymphoma, lymphomatoid granulomatosis. Non-limiting examples of T cell lymphomas include extranodal T cell lymphoma, cutaneous T cell lymphomas, anaplastic large cell lymphoma, and angioimmunoblastic T cell lymphoma. Hematological malignancies also include leukemia, such as, but not limited to, secondary leukemia, chronic lymphocytic leukemia, acute myelogenous leukemia, chronic myelogenous leukemia, and acute lymphoblastic leukemia. Hematological malignancies further include myelomas, such as, but not limited to, multiple myeloma and smoldering multiple myeloma. Other hematological and/or B cell- or T-cell-associated cancers are encompassed by the term hematological malignancy.

The term "effective dose" or "effective dosage" is defined as an amount sufficient to achieve or at least partially achieve a desired effect. A "therapeutically effective amount" or "therapeutically effective dosage" of a drug or therapeutic agent is any amount of the drug that, when used alone or in combination with another therapeutic agent, promotes disease regression evidenced by a decrease in severity of disease symptoms, an increase in frequency and duration of disease symptom-free periods, or a prevention of impairment or disability due to the disease affliction. A therapeutically effective amount or dosage of a drug includes a "prophylactically effective amount" or a "prophylactically effective dosage", which is any amount of the drug that, when administered alone or in combination with another therapeutic agent to a subject at risk of developing a disease or of suffering a recurrence of disease, inhibits the development or recurrence of the disease. The ability of a therapeutic agent to promote disease regression or inhibit the development or recurrence of the disease can be evaluated using a variety of methods known to the skilled practitioner, such as in human subjects during clinical trials, in animal model systems predictive of efficacy in humans, or by assaying the activity of the agent in in vitro assays.

By way of example, an anti-cancer agent is a drug that promotes cancer regression in a subject. In some embodiments, a therapeutically effective amount of the drug promotes cancer regression to the point of eliminating the cancer. "Promoting cancer regression" means that administering an effective amount of the drug, alone or in combination with an antineoplastic agent, results in a reduction in tumor growth or size, necrosis of the tumor, a decrease in severity of at least one disease symptom, an increase in frequency and duration of disease symptom-free periods, a prevention of impairment or disability due to the disease affliction, or otherwise amelioration of disease symptoms in the patient. In addition, the terms "effective" and "effectiveness" with regard to a treatment includes both pharmacological effectiveness and physiological safety. Pharmacological effectiveness refers to the ability of the drug to promote cancer regression in the patient. Physiological safety refers to the level of toxicity, or other adverse physiological effects at the cellular, organ and/or organism level (adverse effects) resulting from administration of the drug.

By way of example for the treatment of tumors, a therapeutically effective amount or dosage of the drug inhibits cell growth or tumor growth by at least about 20%, by at least about 40%, by at least about 60%, or by at least about 80% relative to untreated subjects. In some embodiments, a therapeutically effective amount or dosage of the drug completely inhibits cell growth or tumor growth, i.e., inhibits its cell growth or tumor growth by 100%. The ability of a compound to inhibit tumor growth can be evaluated using the assays described infra. Alternatively, this property of a composition can be evaluated by examining the ability of the compound to inhibit cell growth, such inhibition can be measured in vitro by assays known to the skilled practitioner. In some embodiments described herein, tumor regression can be observed and continue for a period of at least about 20 days, at least about 40 days, or at least about 60 days.

The term "patient" includes human and other mammalian subjects that receive either prophylactic or therapeutic treatment.

As used herein, the term "subject" includes any human or non-human animal. For example, the methods and compositions described herein can be used to treat a subject having cancer. The term "non-human animal" includes all vertebrates, e.g., mammals and non-mammals, such as non-human primates, sheep, dog, cow, chickens, amphibians, reptiles, etc.

The term "weight based" dose or dosing as referred to herein means that a dose that is administered to a patient is calculated based on the weight of the patient. For example, when a patient with 60 kg body weight requires 3 mg/kg of an anti-TIM3 antibody, one can calculate and use the appropriate amount of the anti-TIM3 antibody (i.e., 180 mg) for administration.

The use of the term "fixed dose" with regard to a method of the disclosure means that two or more different antibodies in a single composition (e.g., anti-TIM3 antibody and a second antibody, e.g., a PD-1 or PD-L1 antibody) are present in the composition in particular (fixed) ratios with each other. In some embodiments, the fixed dose is based on the weight (e.g., mg) of the antibodies. In some embodiments, the fixed dose is based on the concentration (e.g., mg/ml) of the antibodies. In some embodiments, the ratio of the two antibodies (e.g., anti-TIM3 and anti-PD1 or anti-PD-L1) is at least about 1:1, about 1:2, about 1:3, about 1:4, about 1:5, about 1:6, about 1:7, about 1:8, about 1:9, about 1:10, about 1:15, about 1:20, about 1:30, about 1:40, about 1:50, about 1:60, about 1:70, about 1:80, about 1:90, about 1:100, about 1:120, about 1:140, about 1:160, about 1:180, about 1:200, about 200:1, about 180:1, about 160:1, about 140:1, about 120:1, about 100:1, about 90:1, about 80:1, about 70:1, about 60:1, about 50:1, about 40:1, about 30:1, about 20:1, about 15:1, about 10:1, about 9:1, about 8:1, about 7:1, about 6:1, about 5:1, about 4:1, about 3:1, or about 2:1 mg first antibody (e.g., anti-TIM3 antibody) to mg second antibody. For example, a 2:1 ratio of an anti-TIM3 antibody and a PD-1 antibody, such as nivolumab, can mean that a vial or an injection can contain about 480 mg of the anti-TIM3 antibody and 240 mg of the anti-PD-1 antibody, or about 2 mg/ml of the anti-TIM3 antibody and 1 mg/ml of the anti-PD-1 antibody.

The use of the term "flat dose" with regard to the methods and dosages described herein means a dose that is administered to a patient without regard for the weight or body surface area (BSA) of the patient. The flat dose is therefore not provided as a mg/kg dose, but rather as an absolute amount of the agent (e.g., the anti-TIM3 antibody). For example, a 60 kg person and a 100 kg person would receive the same dose of an antibody (e.g., 480 mg of an anti-TIM3 antibody).

As used herein, the terms "ug" and "uM" are used interchangeably with "μg" and "μM," respectively.

Various aspects described herein are described in further detail in the following subsections.

I. Anti-Human TIM3 Antibodies

Described herein are antibodies, e.g., fully human antibodies, which are characterized by particular functional features or properties. For example, the antibodies specifically bind human TIM3, and more specifically, a particular domain (e.g., a functional domain) within the extracellular domain of human TIM3. In some embodiments, the antibodies specifically bind to the site on TIM3 to which TIM3-L binds. In some embodiments, the antibodies are antagonist antibodies, i.e., they inhibit or suppress the T cell inhibitory activity of TIM3 on cells, e.g., T cells. In some embodiments, anti-TIM3 antibodies cross-react with TIM3 from one or more non-human primates, such as cynomolgus TIM3. In some embodiments, the antibodies specifically bind to the extracellular region of human TIM3 and the extracellular region of cynomolgus TIM3. In some embodiments, the antibodies bind to human TIM3 with high affinity.

Anti-TIM3 antibodies described herein exhibit one or more of the following functional properties:

(a) binding to soluble and/or membrane bound human TIM3;
(b) binding to soluble and/or membrane bound cyno TIM3;
(c) inducing or stimulating an immune response;
(d) inducing or stimulating T cell activation, e.g., Th1 cell activation (as evidenced, e.g., by enhanced cytokine secretion and/or proliferation);
(e) inducing or stimulating T cell proliferation (e.g., CD4+, CD8+ T cells, Th1 cells, or TILs), e.g., in a coculture assay, such as described in the Examples;
(f) inducing or stimulating IFN-γ production by T cells, e.g., Th1 cells or tumor infiltrating lymphocytes (TILs), such as TILs from human renal, lung, pancreatic, or breast cancer tumors, as determined, e.g., in the assay described in the Examples;
(g) blocking or inhibiting the binding of human TIM3 to PtdSer, as determined, e.g., in the assay described in the Examples;
(h) not internalizing or downregulating cell surface TIM3 when binding to TIM3 on cells;
(i) binding to human TIM3 extracellular domain (i) CPVFECG (SEQ ID NO: 296); (ii) RIQIPGIMND (SEQ ID NO: 298); (iii) CPVFECG and RIQIPGIMND (SEQ ID NOs: 296 and 298, respectively); or (iv) WTSRYWLNGDFR (SEQ ID NO: 297);
(j) competing with, or cross-blocking, the binding to human TIM3 of an antibody binding to TIM3 described herein (e.g., 13A3, 8B9, 8C4, 3G4, 17C3, 17C8, 9F6, 14H7, 23B3, or any of TIM3.2 to TIM3.18, TIM3.24, and TIM3.25), as determined, e.g., in the assay described in the Examples;
(k) binding to human TIM3, but not to human TIM3 having an amino acid substitution of one or more of the following amino acid residues: L48, C58, P59, V60, F61, E62, C63, G64, W78, S80, R81, W83, L84, G86, D87, R89, D104, R111, Q113, G116, M118, and D120, as numbered in SEQ ID NO: 286 (FIG. 25); and
(l) binding to human TIM3 regions $^{49}$VPVCWGKGACPVFE$^{62}$ (SEQ ID NO: 367) and $^{111}$RIQIPGIMNDEKFNLKL$^{127}$ (SEQ ID NO: 368) as determined by HDX-MS;
(m) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography; and/or
(n) competing with or cross-blocking with the binding to human TIM3 of 13A3 or TIM3.18.IgG1.3, e.g., as described in the Examples.

In some embodiments, anti-TIM3 antibodies described herein bind to human TIM3 with high affinity, for example, with a $K_D$ of $10^{-7}$ M or less, $10^{-8}$ M or less, $10^{-9}$ M or less, $10^{-10}$ M or less, $10^{-11}$ M or less, $10^{-12}$ M or less, $10^{-12}$ M to $10^{-7}$ M, $10^{-11}$ M to $10^{-7}$ M, $10^{-10}$ M to $10^{-7}$ M, or $10^{-9}$ M to $10^{-7}$ M. In some embodiments, an anti-TIM3 antibody binds to soluble human TIM3, e.g., as determined by BIACORE™ (e.g., as described in the Examples), with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-7}$ M, $10^{-10}$M to $10^{-7}$ M, $10^{-9}$ M to $10^{-7}$ M, or $10^{-8}$ M to $10^{-7}$ M. In some embodiments, an anti-TIM3 antibody binds to bound (e.g., cell membrane bound) human TIM3, such as on activated human T cells, e.g., as determined by flow cytometry and Scatchard plot, with a $K_D$ of $10^{-7}$ M or less, $10^{-8}$ M or less, $10^{-9}$ M (1 nM) or less, $5 \times 10^{-10}$ M or less, $10^{-10}$ M or less, $10^{-12}$ M to $10^{-7}$ M, $10^{-11}$ M to $10^{-8}$ M, $10^{-10}$ M to $10^{-8}$ M, $10^{-9}$ M to $10^{-8}$ M, $10^{-11}$ M to $10^{-9}$ M, or $10^{-10}$ M to $10^{-9}$ M. In some embodiments, an anti-TIM3 antibody binds to bound (e.g., cell membrane bound) human TIM3, such as on activated human T cells, e.g., as determined by flow cytometry, with an $EC_{50}$ of 10 ug/mL or less, 5 ug/mL or less, 1 ug/mL or less, 0.9 ug/mL or less, 0.8 ug/mL or less, 0.7 ug/mL or less, 0.6 ug/mL or less, 0.5 ug/mL or less, 0.4 ug/mL or less, 0.3 ug/mL or less, 0.2 ug/mL or less, 0.1 ug/mL or less, 0.05 ug/mL or less, or 0.01 ug/mL or less. In some embodiments, anti-TIM3 antibodies described herein bind to cyno TIM3, for example, with a $K_D$ of $10^{-7}$ M or less, $10^{-8}$ M or less, $10^{-9}$ M or less, $10^{-10}$ M or less, $10^{-11}$ M or less, $10^{-12}$ M or less, $10^{-12}$ M to $10^{-7}$ M, $10^{-11}$ M to $10^{-7}$ M, $10^{-10}$ M to $10^{-7}$ M, or $10^{-9}$ M to $10^{-7}$ M. In some embodiments, an anti-TIM3 antibody binds to soluble cyno TIM3, e.g., as determined by BIACORE™ (e.g., as described in the Examples), with a $K_D$ of $10^{-7}$ M or less, $10^{-8}$ M or less, $10^{-9}$ M (1 nM) or less, $10^{-10}$ M or less, $10^{-12}$ M to $10^{-7}$ M, $10^{-11}$ M to $10^{-7}$ M, $10^{-10}$ M to $10^{-7}$ M, $10^{-8}$ M to $10^{-7}$ M, or $10^{-8}$ M to $10^{-7}$ M. Anti-TIM3 antibodies can bind to membrane bound cynomolgus TIM3, e.g., with an $EC_{50}$ of 100 nM or less, 10 nM or less, 100 nM to 0.01 nM, 100 nM to 0.1 nM, 100 nM to 1 nM, or 10 nM to 1 nM, e.g., as measured by flow cytometry (e.g., as described in the Examples). In some embodiments, an anti-TIM3 antibody binds to bound (e.g., cell membrane bound) cyno TIM3, such as on activated human T cells, e.g., as determined by flow cytometry and Scatchard plot, with a $K_D$ of $10^{-7}$ M or less, $10^{-8}$ M or less, $10^{-9}$ M (1 nM) or less, $5 \times 10^{-10}$ M or less, $10^{-10}$ M or less, $10^{-12}$ M to $10^{-7}$ M, $10^{-11}$ M to $10^{-8}$ M, $10^{-10}$ M to $10^{-8}$ M, $10^{-9}$ M to $10^{-8}$ M, $10^{-11}$ M to $10^{-9}$ M, or $10^{-10}$ M to $10^{-9}$ M.

In some embodiments, anti-TIM3 antibodies described herein stimulate or enhance an immune response, e.g., by activating T cells, e.g., in the tumor. For example, the anti-TIM3 antibodies can activate or costimulate cells, as evidenced, e.g., by enhanced cytokine (e.g., IFN-γ) secretion and/or enhanced proliferation, which may result from the inhibition of TIM3 mediated T cell inhibitory activity. In some embodiments, T cell activation or co-stimulation by a TIM3 antibody occurs in the presence of CD3 stimulation. In some embodiments, an anti-TIM3 antibody increases IFN-γ secretion by a factor of 50%, 100% (i.e., 2 fold), 3 fold, 4 fold, 5 fold or more, optionally with a maximum of up to 10 fold, 30 fold, 100 fold, as measured, e.g., on primary human T cells and/or T cells expressing human TIM3, such as tumor infiltrating lymphocytes (TILs).

In some embodiments, anti-TIM3 antibodies inhibit binding of phosphatidylserine to human TIM3 on cells, e.g., CHO cells or activated T cells expressing human TIM3, e.g., with an $EC_{50}$ of 10 µg/ml or less, 1 µg/ml or less, 0.01 µg/ml to 10 µg/ml, 0.1 µg/ml to 10 µg/ml, or 0.1 µg/ml to 1 µg/ml.

In some embodiments, anti-TIM3 antibodies described herein bind to an epitope, e.g., a conformational epitope, in the extracellular portion of human TIM3, e.g., in the Ig like domain of the extracellular region, i.e., amino acids 22 to 202 of SEQ ID NO: 286 (FIG. 25). In some embodiments, an anti-TIM3 antibody binds to an epitope located within amino acids 22 to 120 of human TIM3 extracellular domain (SEQ ID NO: 286) or 1-99 of mature human TIM3 (SEQ ID NO: 290) (see Examples). In some embodiments, an anti-TIM3 antibody binds to, or to an epitope within, a region consisting of amino acids 58-64 of human TIM3 having SEQ ID NO: 286, which corresponds to amino acid residues 37-43 of mature human TIM3 (CPVFECG, SEQ ID NO: 296; see FIG. 25). In some embodiments, an anti-TIM3 antibody binds to, or to an epitope within, a region consisting of amino acids 111-120 of human TIM3 having SEQ ID NO: 286, which corresponds to amino acid residues 90-99 of mature human TIM3 (RIQIPGIMND, SEQ ID NO: 298; see FIG. 25). In some embodiments, an anti-TIM3 antibody binds to, or to an epitope within, a region consisting of a region consisting of amino acids 58-64 of human TIM3 having SEQ ID NO: 286 (CPVFECG, SEQ ID NO: 296) and to, or to an epitope within, a region consisting of amino acids 111-120 of human TIM3 having SEQ ID NO: 286 (RIQIPGIMND, SEQ ID NO: 298; see FIG. 25). In some embodiments, an anti-TIM3 antibody binds to, or to an epitope within, a region consisting of amino acids 78-89 of human TIM3 having SEQ ID NO: 286, which corresponds to amino acid residues 57-83 of mature human TIM3 (WTSRYWLNGDFR, SEQ ID NO: 297; see FIG. 25).

In some embodiments, an anti-TIM3 antibody binds to substantially the same epitope as that of 13A3, i.e., an epitope (or region of human TIM3) comprising one or more of amino acid residues C58, P59, F61, E62, C63, R111, and D120 of SEQ ID NO: 286 (FIG. 25). In some embodiments, an anti-TIM3 antibody binds to an epitope (or region of human TIM3) comprising one or more of amino acid residues C58, P59, F61, E62, C63, D104, R111, Q113 and D120 of SEQ ID NO: 286 (FIG. 25). In some embodiments, an anti-TIM3 antibody does not bind significantly, or only with significantly reduced binding affinity, to a human TIM3 protein in which one or more of amino acid residues C58, P59, F61, E62, C63, R111, and D120 of SEQ ID NO: 286 is changed to another amino acid, e.g., in a non-conservative amino acid substitution. In some embodiments, an anti-TIM3 antibody does not bind significantly, or only with significantly reduced binding affinity, to a human TIM3 protein in which one or more of amino acid residues C58, P59, F61, E62, C63, D104, R111, Q113 and D120 of SEQ ID NO: 286 is changed to another amino acid, e.g., in a non-conservative amino acid substitution.

In some embodiments, an anti-TIM3 antibody binds to substantially the same epitope as that of 3G4, i.e., an epitope (or region of human TIM3) comprising one or more of amino acids residues C58, P59, V60, F61, E62, C63, G116, and M118 of SEQ ID NO: 286 (FIG. 25). In some embodiments, an anti-TIM3 antibody binds to an epitope (or region of human TIM3) comprising one or more of amino acid residues C58, P59, V60, F61, E62, C63, D104, G116, and M118 of SEQ ID NO: 286 (FIG. 25). In some embodiments, an anti-TIM3 antibody does not bind significantly, or only with significantly reduced binding affinity, to a human TIM3 protein in which one or more of amino acid residues C58, P59, V60, F61, E62, C63, G116, and M118 of SEQ ID NO: 286 is changed to another amino acid, e.g., in a non-conservative amino acid substitution. In some embodiments, an anti-TIM3 antibody does not bind significantly, or only with significantly reduced binding affinity, to a human TIM3 protein in which one or more of amino acid residues C58, P59, V60, F61, E62, C63, D104, G116, and M118 of SEQ ID NO: 286 is changed to another amino acid, e.g., in a non-conservative amino acid substitution.

In some embodiments, an anti-TIM3 antibody binds to substantially the same epitope as that of 17C3, i.e., an epitope (or region of human TIM3) comprising one or more of amino acids residues C58, P59, V60, F61, E62, C63, G64, and G116 of SEQ ID NO: 286 (FIG. 25). In some embodiments, an anti-TIM3 antibody binds to an epitope (or region of human TIM3) comprising one or more of amino acid residues C58, P59, V60, F61, E62, C63, G64, D104, and G116 of SEQ ID NO: 286 (FIG. 25). In some embodiments, an anti-TIM3 antibody does not bind significantly, or only with significantly reduced binding affinity, to a human TIM3 protein in which one or more of amino acid residues C58, P59, V60, F61, E62, C63, G64, and G116 of SEQ ID NO: 286 is changed to another amino acid, e.g., in a non-conservative amino acid substitution. In some embodiments, an anti-TIM3 antibody does not bind significantly, or only with significantly reduced binding affinity, to a human TIM3 protein in which one or more of amino acid residues C58, P59, V60, F61, E62, C63, G64, D104, and G116 of SEQ ID NO: 286 is changed to another amino acid, e.g., in a non-conservative amino acid substitution.

In some embodiments, an anti-TIM3 antibody binds to substantially the same epitope as that of 8B9, i.e., an epitope (or region of human TIM3) comprising one or more of amino acids residues L48, W78, S80, R81, W83, G86, D87, and R89 of SEQ ID NO: 286 (FIG. 25). In some embodiments, an anti-TIM3 antibody binds to an epitope (or region of human TIM3) comprising one or more of amino acid residues L48, W78, S80, R81, W83, L84, G86, D87, and R89 of SEQ ID NO: 286 (FIG. 25). In some embodiments, an anti-TIM3 antibody binds to substantially the same epitope as that of 8B9, i.e., an epitope (or region of human TIM3) comprising one or more of amino acids residues L48, W78, S80, R81, W83, G86, D87, R89, and D104 of SEQ ID NO: 286 (FIG. 25). In some embodiments, an anti-TIM3 antibody does not bind significantly, or only with significantly reduced binding affinity, to a human TIM3 protein in which one or more of amino acid residues L48, W78, S80, R81, W83, G86, D87, and R89 of SEQ ID NO: 286 (FIG. 25) is changed to another amino acid, e.g., in a non-conservative amino acid substitution. In some embodiments, an anti-TIM3 antibody does not bind significantly, or only with significantly reduced binding affinity, to a human TIM3 protein in which one or more of amino acid residues L48, W78, S80, R81, W83, L84, G86, D87, and R89 of SEQ ID NO: 286 (FIG. 25) is changed to another amino acid, e.g., in a non-conservative amino acid substitution. In some embodiments an anti-TIM3 antibody does not bind significantly, or only with significantly reduced binding affinity, to a human TIM3 protein in which one or more of amino acid residues L48, W78, S80, R81, W83, G86, D87, R89, and D104 of SEQ ID NO: 286 (FIG. 25) is changed to another amino acid, e.g., in a non-conservative amino acid substitution.

In some embodiments, anti-TIM3 antibodies compete for binding to human TIM3 with (or inhibit binding of) anti-TIM3 antibodies comprising CDRs or variable regions described herein, e.g., those of antibodies 13A3, 3G4, 17C3, 17C8, 9F6, 8B9, 8C4, 14H7, 23B3, and any of TIM3.2 to TIM3.18, TIM3.20, TIM3.21, TIM3.22, TIM3.23, TIM3.24, and TIM3.25. In some embodiments, anti-TIM3 antibodies inhibit binding of antibodies 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 to human TIM3 by at least 50%, 60%, 70%, 80%, 90%6 or by 100%. In some embodiments, 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 inhibit binding of anti-TIM3 antibodies to human TIM3 by at least 50%, 60%, 70%, 80%, 90% or by 100%. In some embodiments, anti-TIM3 antibodies inhibit binding of 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 to human TIM3 by at least 50%, 60%, 70%, 80%, 90% or by 100% and 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 inhibit binding of the anti-TIM3 antibodies to human TIM3 by at least 50%, 60%, 70%, 80%, 90% or by 100% (e.g., compete in both directions).

In some embodiments, anti-TIM3 antibodies have 1, 2, 3, 4, 5, 6, 7, 8, 9, 10, 11, 12, 13, 14, 15, 16, 17, 18, 19, or all of the following features:

(1) binding to soluble human TIM3, e.g., with a $K_D$ of 10 nM or less (e.g., 0.01 nM to 10 nM), e.g., as measured by Biacore, e.g., as described in the Examples;

(2) binding to soluble cynomolgus TIM3, e.g., with a $K_D$ of 100 nM or less (e.g., 0.01 nM to 100 nM), e.g., as measured by Biacore, e.g., as described in the Examples;

(3) binding to membrane bound human TIM3, e.g., with an $EC_{50}$ of 1 ug/mL or less (e.g., 0.01 ug/mL to 1 ug/mL), e.g., as measured by flow cytometry (e.g., as described in the Examples);

(4) binding to membrane bound human TIM3, e.g., with a $K_D$ of 1 nM or less (e.g., 0.01 nM to 10 nM), e.g., as measured by Scatchard analysis, e.g., as described in the Examples;

(5) binding to membrane bound cynomolgus TIM3, e.g., with an $EC_{50}$ of 20 ug/mL or less (e.g., 0.01 ug/mL to 20 ug/mL), e.g., as measured by flow cytometry (e.g., as described in the Examples);

(6) binding to membrane bound cynomolgus TIM3, e.g., with a $K_D$ of 1 nM or less (e.g., 0.01 nM to 10 nM), e.g., as measured by Scatchard analysis, e.g., as described in the Examples;

(7) inducing or enhancing T cell activation (e.g., by blocking or reducing the inhibitory effects of TIM3), as evidenced by (i) increased IFN-γ production in TIM3-expressing T cells (e.g., Th1 cells or TILs) and/or (ii) enhanced proliferation of TIM3 expressing T cells (e.g., Th1 cells or TILs), e.g., as described in the Examples;

(8) stimulating T cell proliferation in a mixed lymphocyte reaction (MLR) assay, e.g., as described in the Examples;

(9) inhibiting the binding of phosphatidylserine to TIM3, e.g., as measured by PS-hTIM3 "in-tandem" blocking assay, e.g., as described in the Examples;

(10) not internalizing or downregulating cell surface TIM3 when binding to TIM3 on cells;

(11) binding to one of the following regions of human TIM3 extracellular domain (SEQ ID NO: 290): (a) CPVFECG (SEQ ID NO: 296); (b) RIQIPGIMND (SEQ ID NO: 298); (c) CPVFECG and RIQIPGIMND (SEQ ID NOs: 296 and 298, respectively); and (d) WTSRYWLNGDFR (SEQ ID NO: 297), e.g., as described in the Examples;

(12) having reduced binding to human TIM3 in which one or more of amino acids L48, C58, P59, V60, F61, E62, C63, G64, W78, S80, R81, W83, L84, G86, D87, R89, D104, R111, Q113, G116, M118, and D120 (as numbered in SEQ ID NO: 286 (FIG. 25)) is substituted with another amino acid relative to binding to wildtype human TIM3, e.g., as described in the Examples;

(13) competing in either direction or both directions for binding to human TIM3 with an antibody comprising VH and VL domains of any one of 13A3, 3G4, 17C3, 17C8, 9F6, 8B9, 8C4, 14H7, 23B3, TIM3.7, TIM3.8, TIM3.10, TIM3.11, TIM3.12, TIM3.13, TIM3.14, TIM3.15, TIM3.16, TIM3.17, TIM3.18, and TIM3.25, e.g., as described in the Examples;

(14) binding to human TIM3 regions $^{49}$VPVCWGKGACPVFE$^{62}$ (SEQ ID NO: 367) and $^{111}$RIQIPGIMNDEKFNLKL$^{127}$ (SEQ ID NO: 368) as determined by HDX-MS, e.g., as described in the Examples;

(15) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (e.g., described in the Examples; numbering per SEQ ID NO: 286 (FIG. 25)); and/or

(16) (a) having reduced binding to human TIM3 in which 1, 2, 3, 4, 5, 6, 7, 8 or 9 of amino acids C58, P59, F61, E62, C63, R111, D120, and optionally D104 and Q113 (numbering per SEQ ID NO: 286 (FIG. 25)) are substituted with another amino acid relative to binding to wildtype human TIM3; (b) binding to $^{49}$VPVCWGKGACPVFE$^{62}$ (SEQ ID NO: 367), $^{111}$RIQIPGIMNDEKFNLKL$^{127}$ (SEQ ID NO: 368) and $^{119}$NDEKFNLKL$^{127}$ (SEQ ID NO: 373), as determined by HDX-MS, as described in the Examples; and/or (c) competing with or cross-blocking with the binding to human TIM3 of 13A3 or TIM3.18.IgG1.3, e.g., as described in the Examples;

(17) binding to hTIM3-IgV with a $K_D$ of $5 \times 10^{-8}$ M, $2 \times 10^{-8}$ M, $10^{-8}$ M or $5 \times 10^{-9}$ M or less, as determined by the method described in Example 22;

(18) binding to hTIM3-IgV with a $K_D$ of $10^{-7}$ M, $2 \times 10^{-8}$ M or $10^{-8}$ M or less, as determined by the method described in Example 22;

(19) binding to cynoTIM3-ECD with a $K_D$ of $5 \times 10^{-7}$ M, $2 \times 10^{-8}$ M or $10^{-8}$ M or less, as determined by the method described in Example 22; and/or

(20) binding to hTIM3-ECD with a $K_D$ of $8 \times 10^{-8}$ M, $5 \times 10^{-8}$ M or $10^{-8}$ M or less, as determined by the method described in Example 22.

Accordingly, an antibody that exhibits one or more of these functional properties (e.g., biochemical, immunochemical, cellular, physiological or other biological activities, or the like) as determined according to methodologies known to the art and described herein, will be understood to exhibit a statistically significant difference in the particular activity relative to that seen in the absence of the antibody (e.g., or when a control antibody of irrelevant specificity is present). In some embodiments, anti-TIM3 antibody-induced increases in a measured parameter (e.g., T cell proliferation, cytokine production) in a given assay effects a statistically significant increase by at least 10% of the measured parameter, e.g., by at least 20%, 30%, 40%. 50%, 60%, 70%, 80%, 90%, 95%, 100% (i.e., 2 fold), 3 fold, 5 fold or 10 fold, and in some embodiments, an antibody described herein can increase the measured parameter, e.g., by greater than 92%, 94%, 95%, 97%, 98%, 99%, 100% (i.e., 2 fold), 3 fold, 5 fold or 10 fold, relative to the same assay conducted in the absence of the antibody. Conversely, anti-TIM3 antibody-induced decreases in a measured parameter (e.g., tumor volume, TIM3-L binding to human TIM3) in a given assay effects a statistically significant decrease by at least 10% of the measured parameter, e.g., by at least 20%, 30%, 40%, 50%, 60%, 70%, 80% or 90%, and in some embodiments, an antibody described herein can decrease the measured parameter, e.g., by greater than 92%, 94%, 95%, 97%, 98% or 99%, relative to the same assay conducted in the absence of the antibody.

Standard assays to evaluate the binding ability of the antibodies toward TIM3 of various species are known in the art, including for example, ELISAs, Western blots, and RIAs. Suitable assays are described in detail in the Examples. The binding kinetics (e.g., binding affinity) of the antibodies can also be assessed by standard assays known in the art, such as by Biacore analysis. Assays to evaluate the effects of the antibodies on functional properties of TIM3 (e.g., ligand binding, T cell proliferation, cytokine production) are described in further detail infra and in the Examples.

In some embodiments, anti-TIM3 antibodies are not native antibodies or are not naturally-occurring antibodies. For example, anti-TIM3 antibodies have post-translational modifications that are different from those of antibodies that are naturally-occurring, such as by having more, less or a different type of post-translational modification.

In some embodiments, anti-TIM3 antibodies do not have agonist activity, as determined, e.g., in cross-linking of anti-TIM3 antibodies in CHO-OKT3-CD32:T cell co-culture experiments, in which such antibodies do not enhance activity beyond anti-TIM3 alone. In some embodiments, anti-TIM3 antibodies block the interaction of TIM3 with its ligand without promoting agonist activity.

In some embodiments, anti-TIM3 antibodies enhance IL-12 production from monocytes or dendritic cells treated with LPS.

In some embodiments, anti-TIM3 antibodies revive tumor infiltrating CD8$^+$ T cells that co-express PD-1 and TIM3 by combined treatment, hence avoiding depletion of CD8$^+$ T cells.

II. Exemplary Anti-TIM3 Antibodies

Particular anti-TIM3 antibodies described herein are antibodies, e.g., monoclonal, recombinant, and/or human antibodies, having the CDR and/or variable region sequences of antibodies 13A3, 3G4, 17C3, 17C8, 9F6, 8B9, 8C4, 14H7, 23B3, or any one of TIM3.2 to TIM3.18, TIM3.20, TIM3.21, TIM3.22, TIM3.23, TIM3.24, and TIM3.25, isolated and structurally characterized as described herein, as well as antibodies having at least 80% identity (e.g., at least 85%, at least 90%, at least 95%, or at least 99% identity) to their variable region or CDR sequences. See PCT/US2017/041946, which is incorporated by reference in its entirety. The VH amino acid sequences of 13A3, 8B9, 8C4, 17C3, 9F6, 3G4, 17C8, 14H7, and 23B3 are set forth in SEQ ID NOs: 34-40, 410, and 411, respectively. The VH amino acid sequences of mutated versions of 13A3, 8B9, 9F6, and 23B3 are set forth in SEQ ID NOs: 112-121, 364, and 412. The VL amino acid sequences of 13A3, 17C3, and 3G4 are set forth in SEQ ID NO: 60. The VL amino acid sequences of 8B9, 8C4, and 17C8 are set forth in SEQ ID NO: 61. The VL amino acid sequence of 9F6 are set forth in SEQ ID NOs: 61, 62, and 63. The VL amino acid sequences of 14H7 are set forth in SEQ ID NO: 417. The VL amino acid sequences of 23B3 are set forth in SEQ ID NOs: 60 and 418. The VL amino acid sequences of the mutated versions of 13A3, 8B9 9F6, and 23B3 are those of the corresponding nonmutated antibodies. The VL amino acid sequences of TIM3.21 and TIM3.23 are set forth in SEQ ID NO: 63. A summary of the identity of SEQ ID NOs is provided in FIG. 16.

Accordingly, provided herein are isolated antibodies, or antigen binding portion thereof, comprising heavy and light chain variable regions, wherein the heavy chain variable region comprises an amino acid sequence selected from the group consisting of SEQ ID NOs: 34-40, 112-121, 364, and 410-412.

Also provided are isolated antibodies, or antigen binding portions thereof, comprising heavy and light chain variable regions, wherein the light chain variable region comprises an amino acid sequence selected from the group consisting of SEQ ID NOs: 60-63, 417, and 418.

Provided herein are isolated anti-human TIM3 antibodies, or antigen binding portion thereof, comprising:

(a) heavy and light chain variable region sequences comprising SEQ ID NOs: 34 and 60, respectively;

(b) heavy and light chain variable region sequences comprising SEQ ID NOs: 35 and 61, respectively;

(c) heavy and light chain variable region sequences comprising SEQ ID NOs: 36 and 61, respectively;

(d) heavy and light chain variable region sequences comprising SEQ ID NOs: 37 and 60, respectively;

(e) heavy and light chain variable region sequences comprising SEQ ID NOs: 38 and 61, respectively;

(f) heavy and light chain variable region sequences comprising SEQ ID NOs: 38 and 62, respectively;

(g) heavy and light chain variable region sequences comprising SEQ ID NOs: 38 and 63, respectively;

(h) heavy and light chain variable region sequences comprising SEQ ID NOs: 39 and 60, respectively;

(i) heavy and light chain variable region sequences comprising SEQ ID NOs: 40 and 61, respectively;
(j) heavy and light chain variable region sequences comprising SEQ ID NOs: 121 and 63, respectively;
(k) heavy and light chain variable region sequences comprising SEQ ID NOs: 120 and 61, respectively;
(l) heavy and light chain variable region sequences comprising SEQ ID NOs: 112 and 60, respectively;
(m) heavy and light chain variable region sequences comprising SEQ ID NOs: 113 and 60, respectively;
(n) heavy and light chain variable region sequences comprising SEQ ID NOs: 114 and 60, respectively;
(o) heavy and light chain variable region sequences comprising SEQ ID NOs: 115 and 60, respectively;
(p) heavy and light chain variable region sequences comprising SEQ ID NOs: 116 and 60, respectively;
(q) heavy and light chain variable region sequences comprising SEQ ID NOs: 117 and 60, respectively;
(r) heavy and light chain variable region sequences comprising SEQ ID NOs: 118 and 60, respectively;
(s) heavy and light chain variable region sequences comprising SEQ ID NOs: 119 and 60, respectively;
(t) heavy and light chain variable region sequences comprising SEQ ID NOs: 364 and 60, respectively;
(u) heavy and light chain variable region sequences comprising SEQ ID NOs: 410 and 417, respectively;
(v) heavy and light chain variable region sequences comprising SEQ ID NOs: 411 and 60, respectively;
(w) heavy and light chain variable region sequences comprising SEQ ID NOs: 411 and 418, respectively; and
(x) heavy and light chain variable region sequences comprising SEQ ID NOs: 412 and 60, respectively.

Anti-TIM3 antibodies can comprise the heavy and light chain CDR1s, CDR2s and CDR3s of 13A3, 8B9, 8C4, 17C3, 9F6, 3G4, 17C8, 14H7, 23B3, or any one of TIM3.2 to TIM3.18, TIM3.20, TIM3.21, TIM3.22, TIM3.23, TIM3.24, or TIM3.25, or combinations thereof. The amino acid sequences of the VH CDR1s of 13A3, 8B9, 8C4, and 17C3 are set forth in SEQ ID NOs: 41-44, respectively. The amino acid sequences of the VH CDR1s of 9F6, 3G4, 17C8, 14H7, and 23B3 are set forth in SEQ ID NO 45. The amino acid sequence of the VH CDR1 of the mutated 13A3 antibodies (i.e., TIM3.10-TIM3.18) is the same as that of the nonmutated 13A3 antibody, i.e., SEQ ID NO: 41. The amino acid sequence of the VH CDR1 of the mutated 8B9 antibody (i.e., TIM3.8) is the same as that of the nonmutated 8B9 antibody, i.e., SEQ ID NO: 42. The amino acid sequence of the VH CDR1 of the mutated 9F6 antibody (i.e., TIM3.7) is the same as that of the nonmutated 9F6 antibody, i.e., SEQ ID NO: 45. The amino acid sequence of the VH CDR1 of the mutated 23B3 antibody (i.e., TIM3.25) is the same as that of the nonmutated 23B3 antibody, i.e., SEQ ID NO: 45.

The amino acid sequences of the VH CDR2s of 13A3, 8B9, 8C4, 17C3, 9F6, 3G4, 17C8, 14H7, and 23B3 are set forth in SEQ ID NOs: 46-52, 413, and 415, respectively. The amino acid sequence of the VH CDR2s of the mutated 13A3 antibodies TIM3.10, TIM3.17, and TIM3.18 is set forth in SEQ ID NO: 122. The amino acid sequence of the VH CDR2s of the mutated 13A3 antibodies TIM3.11 and TIM3.12 are set forth in SEQ ID NOs: 123 and 124, respectively. The amino acid sequence of the VH CDR2 of the mutated 13A3 antibodies TIM3.13 and TIM3.16 is that of the nonmutated 13A3 antibody, i.e., SEQ ID NO: 46. The amino acid sequence of the VH CDR2 of the mutated 8B9 antibody (i.e., TIM3.8) is set forth in SEQ ID NO: 125. The amino acid sequence of the VH CDR2 of the mutated 9F6 antibody (i.e., TIM3.7) is the same as that of the nonmutated 9F6 antibody, i.e., SEQ ID NO: 50. The amino acid sequence of the VH CDR2 of the mutated 23B3 antibody (i.e., TIM3.25) is the same as that of the nonmutated 23B3 antibody, i.e., SEQ ID NO: 415.

The amino acid sequences of the VH CDR3s of 13A3, 8B9, 8C4, 17C3, 9F6, 3G4, 17C8, 14H7, and 23B3 are set forth in SEQ ID NOs: 53-59, 414, and 416, respectively. The amino acid sequence of the VH CDR3s of the mutated 13A3 antibodies TIM3.10 to TIM3.12 is that of the nonmutated 13A3 antibody, i.e., SEQ ID NO: 53. The amino acid sequence of the VH CDR3s of the mutated 13A3 antibodies TIM3.13 and TIM3.18 is set forth in SEQ ID NO: 126. The amino acid sequence of the VH CDR3s of the mutated 13A3 antibodies TIM3.15 and TIM3.17 is set forth in SEQ ID NO: 128. The amino acid sequences of the VH CDR3s of the mutated 13A3 antibodies TIM3.14 and TIM3.16 are set forth in SEQ ID NOs: 127 and 129, respectively. The amino acid sequence of the VH CDR3 of the mutated 8B9 antibody (i.e., TIM3.8) is that of the nonmutated 8B9 antibody, i.e., SEQ ID NO: 54. The amino acid sequence of the VH CDR3 of the mutated 9F6 antibody (i.e., TIM3.7) is the same as that of the nonmutated 9F6 antibody, i.e., SEQ ID NO: 57. The amino acid sequence of the VH CDR3 of the mutated 23B3 antibody (i.e., TIM3.25) is the same as that of the nonmutated 23B3 antibody, i.e., SEQ ID NO: 416.

The amino acid sequences of the VL CDR1s of 13A3, 8B9, 8C4, 17C3, 3G4, 17C8, 14H7, and 23B3 are set forth in SEQ ID NO: 64. The amino acid sequences of the VL CDR1 of 9F6 is set forth in SEQ ID NOs: 64 and 65. The amino acid sequences of the VL CDR2s of 13A3, 8B9, 8C4, 17C3, 3G4, 17C8, 14H7, and 23B3 are set forth in SEQ ID NO: 66. The amino acid sequences of the VL CDR2 of 9F6 is set forth in SEQ ID NOs: 66 and 67. The amino acid sequences of the VL CDR3s of 13A3, 17C3, and 3G4 are set forth in SEQ ID NO: 68. The amino acid sequences of the VL CDR3s of 8B9, 8C4, 17C8, and 14H7 are set forth in SEQ ID NO: 69. The amino acid sequences of the VL CDR3 of 9F6 are set forth in SEQ ID NOs: 69, 70, and 71. The amino acid sequences of the VL CDR3 of 23B3 are set forth in SEQ ID NOs: 68 and 419. The amino acid sequences of the VL CDRs of the mutated antibodies 13A3, 8B9, 9F6, and 23B3 are those of the corresponding nonmutated antibodies. FIG. 16 provides a list of the SEQ ID NOs for the CDRs of anti-TIM3 antibodies described herein.

The CDR regions are delineated using the Kabat system (Kabat, E. A., et al. (1991) Sequences of Proteins of Immunological Interest, Fifth Edition, U.S. Department of Health and Human Services, NIH Publication No. 91-3242). Kabat system is the most common numbering system for a scheme called the EU index or EU numbering system, which is based on the sequential numbering of the first human IgG1 sequenced (the EU antibody; Edelman et al. 1969). Based on the Kabat numbering scheme disclosed herein, the antibody numbering can be converted into other systems known in the art, e.g., Chotia, IMGT, Martin (enhanced Chothia), or AHo numbering scheme.

Given that each of these antibodies bind to human TIM3 and that antigen-binding specificity is provided primarily by the CDR1, 2 and 3 regions, the VH CDR1, 2 and 3 sequences and VL CDR1, 2 and 3 sequences, e.g., those in FIG. 16, can be "mixed and matched" (i.e., CDRs from different antibodies can be mixed and match, although each antibody must contain a VH CDR1, 2 and 3 and a VL CDR1, 2 and 3) to create other anti-TIM3 binding molecules described herein. TIM3 binding of such "mixed and matched" antibodies can be tested using the binding assays described above and in the Examples (e.g., ELISAs). In some embodiments, when VH CDR sequences are mixed and matched, the CDR1, CDR2 and/or CDR3 sequence from a particular VH sequence is replaced with a structurally similar CDR sequence(s). Likewise, when VL CDR sequences are mixed and matched, the CDR1, CDR2 and/or CDR3 sequence from a particular VL sequence is replaced with a structurally similar CDR sequence(s). It will be readily apparent to the ordinarily skilled artisan that novel VH and VL sequences can be created by substituting one or more VH and/or VL CDR region sequences with structurally similar sequences from the CDR sequences disclosed herein for monoclonal antibodies 13A3, 8B9, 8C4, 17C3, 9F6, 3G4, 17C8, 14H7, 23B3, and any one of TIM3.2 to TIM3.18, TIM3.20, TIM3.21, TIM3.22, TIM3.23, TIM3.24, and TIM3.25.

Provided herein are isolated anti-human TIM3 antibodies, or antigen binding portion thereof comprising:
(a) a heavy chain variable region CDR1 comprising an amino acid sequence selected from the group consisting of SEQ ID NOs: 41-45;
(b) a heavy chain variable region CDR2 comprising an amino acid sequence selected from the group consisting of SEQ ID NOs: 46-52,122-125, 413, and 415;
(c) a heavy chain variable region CDR3 comprising an amino acid sequence selected from the group consisting of SEQ ID NOs: 53-59, 126-129, 414, and 416;
(d) a light chain variable region CDR1 comprising an amino acid sequence selected from the group consisting of SEQ ID NOs: 64-65;
(e) a light chain variable region CDR2 comprising an amino acid sequence selected from the group consisting of SEQ ID NOs: 66-67; and
(f) a light chain variable region CDR3 comprising an amino acid sequence selected from the group consisting of SEQ ID NOs: 68-71, and 419; wherein the antibody specifically binds to human TIM3.

In some embodiments, the anti-human TIM3 antibody comprises heavy and light chain variable regions, wherein the heavy chain variable region CDR1, CDR2, and CDR3 regions comprise:
(a) SEQ ID NOs: 41, 46, 53;
(b) SEQ ID NOs: 42, 47, 54;
(c) SEQ ID NOs: 43, 48, 55;
(d) SEQ ID NOs: 44, 49, 56;
(e) SEQ ID NOs: 45, 50, 57;
(f) SEQ ID NOs: 45, 51, 58;
(g) SEQ ID NOs: 45, 52, 59;
(h) SEQ ID NOs: 41, 122, 53;
(i) SEQ ID NOs: 41, 123, 53;
(j) SEQ ID NOs: 41, 124, 53;
(k) SEQ ID NOs: 41, 46, 126;
(l) SEQ ID NOs: 41, 46, 127;
(m) SEQ ID NOs: 41, 46, 128;
(n) SEQ ID NOs: 41, 46, 129;
(o) SEQ ID NOs: 41, 122, 128;
(p) SEQ ID NOs: 41, 122, 126;
(q) SEQ ID NOs: 45, 413, 414; or
(r) SEQ ID NOs: 45, 415, 416, wherein the antibody specifically binds to human TIM3.

In some embodiments, the anti-human TIM3 antibody comprises heavy and light chain variable regions, wherein the light chain variable region CDR1, CDR2, and CDR3 regions comprise:
(a) SEQ ID NOs: 64, 66, 68;
(b) SEQ ID NOs: 64, 66, 69;
(c) SEQ ID NOs: 65, 67, 70;
(d) SEQ ID NOs: 64, 66, 71; or
(e) SEQ ID NOs: 64, 66, 419, wherein the antibody specifically binds to human TIM3.

In some embodiments, the anti-TIM3 antibody comprises heavy and light chain variable regions, wherein:
(a1) the heavy chain variable region CDR1, CDR2, and CDR3 comprises SEQ ID NOs: 41, 46, 53, respectively, and the light chain variable region CDR1, CDR2, and CDR3 comprises SEQ ID NOs: 64, 66, 68, respectively;
(a2) the heavy chain variable region CDR1, CDR2, and CDR3 comprises SEQ ID NOs: 41, 122, 53, respectively, and the light chain variable region CDR1, CDR2, and CDR3 comprises SEQ ID NOs: 64, 66, 68, respectively;
(a3) the heavy chain variable region CDR1, CDR2, and CDR3 comprises SEQ ID NOs: 41, 123, 53, respectively, and the light chain variable region CDR1, CDR2, and CDR3 comprises SEQ ID NOs: 64, 66, 68, respectively;
(a4) the heavy chain variable region CDR1, CDR2, and CDR3 comprises SEQ ID NOs: 41, 124, 53, respectively, and the light chain variable region CDR1, CDR2, and CDR3 comprises SEQ ID NOs: 64, 66, 68, respectively;
(a5) the heavy chain variable region CDR1, CDR2, and CDR3 comprises SEQ ID NOs: 41, 46, 126, respectively, and the light chain variable region CDR1, CDR2, and CDR3 comprises SEQ ID NOs: 64, 66, 68, respectively;
(a6) the heavy chain variable region CDR1, CDR2, and CDR3 comprises SEQ ID NOs: 41, 46, 127, respectively, and the light chain variable region CDR1, CDR2, and CDR3 comprises SEQ ID NOs: 64, 66, 68, respectively;
(a7) the heavy chain variable region CDR1, CDR2, and CDR3 comprises SEQ ID NOs: 41, 46, 128, respectively, and the light chain variable region CDR1, CDR2, and CDR3 comprises SEQ ID NOs: 64, 66, 68, respectively;
(a8) the heavy chain variable region CDR1, CDR2, and CDR3 comprises SEQ ID NOs: 41, 46, 129, respectively, and the light chain variable region CDR1, CDR2, and CDR3 comprises SEQ ID NOs: 64, 66, 68, respectively;
(a9) the heavy chain variable region CDR1, CDR2, and CDR3 comprises SEQ ID NOs: 41, 122, 128, respectively, and the light chain variable region CDR1, CDR2, and CDR3 comprises SEQ ID NOs: 64, 66, 68, respectively;
(a10) the heavy chain variable region CDR1, CDR2, and CDR3 comprises SEQ ID NOs: 41, 122, 126, respectively, and the light chain variable region CDR1, CDR2, and CDR3 comprises SEQ ID NOs: 64, 66, 68, respectively;
(b1) the heavy chain variable region CDR1, CDR2, and CDR3 comprises SEQ ID NOs: 42, 47, 54, respectively, and the light chain variable region CDR1, CDR2, and CDR3 comprises SEQ ID NOs: 64, 66, 69, respectively;
(b2) the heavy chain variable region CDR1, CDR2, and CDR3 comprises SEQ ID NOs: 42, 125, 54, respectively, and the light chain variable region CDR1, CDR2, and CDR3 comprises SEQ ID NOs: 64, 66, 69, respectively;
(c) the heavy chain variable region CDR1, CDR2, and CDR3 comprises SEQ ID NOs: 43, 48, 55, respectively, and the light chain variable region CDR1, CDR2, and CDR3 comprises SEQ ID NOs: 64, 66, 69, respectively;

(d) the heavy chain variable region CDR1, CDR2, and CDR3 comprises SEQ ID NOs: 44, 49, 56, respectively, and the light chain variable region CDR1, CDR2, and CDR3 comprises SEQ ID NOs: 64, 66, 68, respectively;

(e1) the heavy chain variable region CDR1, CDR2, and CDR3 comprises SEQ ID NOs: 45, 50, 57, respectively, and the light chain variable region CDR1, CDR2, and CDR3 comprises SEQ ID NOs: 64, 66, 69, respectively;

(e2) the heavy chain variable region CDR1, CDR2, and CDR3 comprises SEQ ID NOs: 45, 50, 57, respectively, and the light chain variable region CDR1, CDR2, and CDR3 comprises SEQ ID NOs: 64, 66, 71, respectively;

(e3) the heavy chain variable region CDR1, CDR2, and CDR3 comprises SEQ ID NOs: 45, 50, 57, respectively, and the light chain variable region CDR1, CDR2, and CDR3 comprises SEQ ID NOs: 65, 67, 70, respectively;

(f) the heavy chain variable region CDR1, CDR2, and CDR3 comprises SEQ ID NOs: 45, 51, 58, respectively, and the light chain variable region CDR1, CDR2, and CDR3 comprises SEQ ID NOs: 64, 66, 68, respectively;

(g) the heavy chain variable region CDR1, CDR2, and CDR3 comprises SEQ ID NOs: 45, 52, 59, respectively, and the light chain variable region CDR1, CDR2, and CDR3 comprises SEQ ID NOs: 64, 66, 69, respectively;

(h) the heavy chain variable region CDR1, CDR2, and CDR3 comprises SEQ ID NOs: 45, 413, 414, respectively, and the light chain variable region CDR1, CDR2, and CDR3 comprises SEQ ID NOs: 64, 66, 69, respectively;

(i1) the heavy chain variable region CDR1, CDR2, and CDR3 comprises SEQ ID NOs: 45, 415, 416, respectively, and the light chain variable region CDR1, CDR2, and CDR3 comprises SEQ ID NOs: 64, 66, 68, respectively; or (i2) the heavy chain variable region CDR1, CDR2, and CDR3 comprises SEQ ID NOs: 45, 415, 416, respectively, and the light chain variable region CDR1, CDR2, and CDR3 comprises SEQ ID NOs: 64, 66, 419, respectively; wherein the antibody specifically binds to human TIM3.

A VH domain, or one or more CDRs thereof, described herein can be linked to a constant domain for forming a heavy chain, e.g., a full length heavy chain. Similarly, a VL domain, or one or more CDRs thereof, described herein can be linked to a constant domain for forming a light chain, e.g., a full length light chain. A full length heavy chain (with the exception of the C-terminal lysine (K) or with the exception of the C-terminal glycine and lysine (GK), which can be absent) and full length light chain combine to form a full length antibody.

A VH domain described herein can be fused to the constant domain of a human IgG, e.g., IgG1, IgG2, IgG3 or IgG4, which are either naturally-occurring or modified, e.g., as further described herein. For example, a VH domain can comprise the amino acid sequence of any VH domain described herein fused to a human IgG, e.g., an IgG1, constant region, such as the following wild-type human IgG1 constant domain amino acid sequence:

(SEQ ID NO: 291)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSRW

QQGNVFSCSVMHEALHNHYTQKSLSLSPGK or that of an allotypic variant of SEQ ID NO: 291 and have the following amino acid sequences:

ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK (SEQ ID NO: 277;

"IgG1f," allotype specific amino acid residues are in bold and underlined)

A VH domain of an anti-TIM3 antibody can comprise the amino acid sequence of any VH domain described herein fused to an effectorless constant region, e.g., the following effectorless human IgG1 constant domain amino acid sequences:

ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPEAEGAPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPSSIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK (SEQ ID NO: 294;

"IgG1.1f," comprising substitutions L234A, L235E,

G237A, A330S and P331S, which are underlined)

or

ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPEAEGAPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

```
LVKGFYPSDIAVEWESNGQPENNYKTTPPVLDSDGSFFLYSKLTVDKSRW

QQGNVFSCSVMHEALHNHYTQKSLSLSPGK (SEQ ID NO: 295;

"IgG1.3f", comprising substitutions L234A, L235E and G237A, which are underlined)
```

For example, an allotypic variant of IgG1 comprises an K97R, D239E, and/or L241M (underlined and bolded above) and numbering according to that in SEQ ID NOs: 277, 294, and 295. Within the full length heavy region, e.g., 8C4 (SEQ ID NO: 3) and according to EU numbering, these amino acid substitutions are numbered K214R, D356E, and L358M. In some embodiments, the constant region of an anti-TIM3 antibody can further comprises one or more mutations or substitutions at amino acids L117, A118, G120, A213, and P214 (underlined above) as numbered in SEQ ID NO: 277, 294, and 295, or L234, A235, G237, A330 and P331, per EU numbering. In some embodiments, the constant region of an anti-TIM3 antibody comprises one or more mutations or substitutions at amino acids L117A, A118E, G120A, A213S, and P214S of SEQ ID NO: 291, or L234A, L235E, G237A, A330S and P331S, per EU numbering. The constant region of an anti-TIM3 antibody may also comprise one or more mutations or substitutions L117A, A118E and G120A of SEQ ID NO: 291, or L234A, L235E and G237A, per EU numbering Alternatively, a VH domain of an anti-TIM3 antibody can comprise the amino acid sequence of any VH domain described herein fused to a human IgG4 constant region, e.g., the following human IgG4 amino acid sequence or variants thereof:

```
ASTKGPSVFPLAPCSRSTSESTAALGCLVKDYFPEPVTVSWNSGALTSGV

HTFPAVLQSSGLYSLSSVVTVPSSSLGTKTYTCNVDHKPSNTKVDKRVES

KYGPPCPSCPAPEFLGGPSVFLFPPKPKDTLMISRTPEVTCVVVDVSQED

PEVQFNWYVDGVEVHNAKTKPREEQFNSTYRVVSVLTVLHQDWLNGKEYK

CKVSNKGLPSSIEKTISKAKGQPREPQVYTLPPSQEEMTKNQVSLTCLVK

GFYPSDIAVEWESNGQPENNYKTTPPVLDSDGSFFLYSRLTVDKSRWQEG

NVFSCSVMHEALHNHYTQKSLSLSLGK (SEQ ID NO: 292, comprising S228P).
```

A VL domain described herein can be fused to the constant domain of a human Kappa or Lambda light chain. For example, a VL domain of an anti-TIM3 antibody can comprise the amino acid sequence of any VL domain described herein fused to the following human IgG1 kappa light chain amino acid sequence:

```
                                    (SEQ ID NO: 278)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC
```

In some embodiments, the heavy chain constant region comprises a lysine or another amino acid at the C-terminus, e.g., it comprises the following last amino acids: LSPGK (SEQ ID NO: 279) in the heavy chain. In some embodiments, the heavy chain constant region is lacking one or more amino acids at the C-terminus, and has, e.g., the C-terminal sequence LSPG (SEQ ID NO: 280) or LSP (SEQ ID NO: 281).

The amino acid sequences of exemplary heavy and light chains correspond to SEQ ID NOs: 1-28, 72-111, 301-354, for the heavy chains and SEQ ID NOs: 29-30 and 32-33 for the light chains.

Provided herein are isolated anti-human TIM3 antibodies, or antigen binding portion thereof, comprising:
- (a1) heavy and light chain sequences comprising SEQ ID NOs: 301 (or 302) and 29, respectively;
- (a2) heavy and light chain sequences comprising SEQ ID NOs: 1 (or 8) and 29, respectively;
- (a3) heavy and light chain sequences comprising SEQ ID NOs: 15 (or 22) and 29, respectively;
- (a4) heavy and light chain sequences comprising SEQ ID NOs: 303 (or 304) and 29, respectively;
- (a5) heavy and light chain sequences comprising SEQ ID NOs: 72 (or 82) and 29, respectively;
- (a6) heavy and light chain sequences comprising SEQ ID NOs: 92 (or 102) and 29, respectively;
- (a7) heavy and light chain sequences comprising SEQ ID NOs: 305 (or 306) and 29, respectively;
- (a8) heavy and light chain sequences comprising SEQ ID NOs: 73 (or 83) and 29, respectively;
- (a9) heavy and light chain sequences comprising SEQ ID NOs: 93 (or 103) and 29, respectively;
- (a10) heavy and light chain sequences comprising SEQ ID NOs: 307 (or 308) and 29, respectively;
- (a11) heavy and light chain sequences comprising SEQ ID NOs: 74 (or 84) and 29, respectively;
- (a12) heavy and light chain sequences comprising SEQ ID NOs: 94 (or 104) and 29, respectively;
- (a13) heavy and light chain sequences comprising SEQ ID NOs: 309 (or 310) and 29, respectively;
- (a14) heavy and light chain sequences comprising SEQ ID NOs: 75 (or 85) and 29, respectively;
- (a15) heavy and light chain sequences comprising SEQ ID NOs: 95 (or 105) and 29, respectively;
- (a16) heavy and light chain sequences comprising SEQ ID NOs: 311 (or 312) and 29, respectively;
- (a17) heavy and light chain sequences comprising SEQ ID NOs: 76 (or 86) and 29, respectively;
- (a18) heavy and light chain sequences comprising SEQ ID NOs: 96 (or 106) and 29, respectively;
- (a19) heavy and light chain sequences comprising SEQ ID NOs: 313 (or 314) and 29, respectively;
- (a20) heavy and light chain sequences comprising SEQ ID NOs: 77 (or 87) and 29, respectively;
- (a21) heavy and light chain sequences comprising SEQ ID NOs: 97 (or 107) and 29, respectively;
- (a22) heavy and light chain sequences comprising SEQ ID NOs: 315 (or 316) and 29, respectively;
- (a23) heavy and light chain sequences comprising SEQ ID NOs: 78 (or 88) and 29, respectively;
- (a24) heavy and light chain sequences comprising SEQ ID NOs: 98 (or 108) and 29, respectively;
- (a25) heavy and light chain sequences comprising SEQ ID NOs: 317 (or 318) and 29, respectively;
- (a26) heavy and light chain sequences comprising SEQ ID NOs: 79 (or 89) and 29, respectively;
- (a27) heavy and light chain sequences comprising SEQ ID NOs: 99 (or 109) and 29, respectively;
- (a28) heavy and light chain sequences comprising SEQ ID NOs: 319 (or 320) and 29, respectively;
- (a29) heavy and light chain sequences comprising SEQ ID NOs: 349 (or 350) and 29, respectively;

(a30) heavy and light chain sequences comprising SEQ ID NOs: 351 (or 352) and 29, respectively;
(a31) heavy and light chain sequences comprising SEQ ID NOs: 353 (or 354) and 29, respectively;
(b1) heavy and light chain sequences comprising SEQ ID NOs: 321 (or 322) and 30, respectively;
(b2) heavy and light chain sequences comprising SEQ ID NOs: 2 (or 9) and 30, respectively;
(b3) heavy and light chain sequences comprising SEQ ID NOs: 16 (or 23) and 30, respectively;
(b4) heavy and light chain sequences comprising SEQ ID NOs: 323 (or 324) and 30, respectively;
(b5) heavy and light chain sequences comprising SEQ ID NOs: 80 (or 90) and 30, respectively;
(b6) heavy and light chain sequences comprising SEQ ID NOs: 100 (or 110) and 30, respectively;
(b7) heavy and light chain sequences comprising SEQ ID NOs: 325 (or 326) and 30, respectively;
(c1) heavy and light chain sequences comprising SEQ ID NOs: 327 (or 328) and 30, respectively;
(c2) heavy and light chain sequences comprising SEQ ID NOs: 3 (or 10) and 30, respectively;
(c3) heavy and light chain sequences comprising SEQ ID NOs: 17 (or 24) and 30, respectively;
(c4) heavy and light chain sequences comprising SEQ ID NOs: 329 (or 330) and 30, respectively;
(d1) heavy and light chain sequences comprising SEQ ID NOs: 331 (or 332) and 29, respectively;
(d2) heavy and light chain sequences comprising SEQ ID NOs: 4 (or 11) and 29, respectively;
(d3) heavy and light chain sequences comprising SEQ ID NOs: 18 (or 25) and 29, respectively;
(d4) heavy and light chain sequences comprising SEQ ID NOs: 333 (or 334) and 29, respectively;
(e1.1) heavy and light chain sequences comprising SEQ ID NOs: 335 (or 336) and 32, respectively;
(e1.2) heavy and light chain sequences comprising SEQ ID NOs: 335 (or 336) and 33, respectively;
(e1.3) heavy and light chain sequences comprising SEQ ID NOs: 335 (or 336) and 31, respectively;
(e2) heavy and light chain sequences comprising SEQ ID NOs: 5 (or 12) and 33, respectively;
(e3) heavy and light chain sequences comprising SEQ ID NOs: 19 (or 26) and 33, respectively;
(e4) heavy and light chain sequences comprising SEQ ID NOs: 337 (or 338) and 33, respectively;
(e5) heavy and light chain sequences comprising SEQ ID NOs: 81 (or 91) and 33, respectively;
(e6) heavy and light chain sequences comprising SEQ ID NOs: 101 (or 111) and 33, respectively;
(e7) heavy and light chain sequences comprising SEQ ID NOs: 339 (or 340) and 33, respectively;
(f1) heavy and light chain sequences comprising SEQ ID NOs: 341 (or 342) and 29, respectively;
(f2) heavy and light chain sequences comprising SEQ ID NOs: 6 (or 13) and 29, respectively;
(f3) heavy and light chain sequences comprising SEQ ID NOs: 20 (or 27) and 29, respectively;
(f4) heavy and light chain sequences comprising SEQ ID NOs: 343 (or 344) and 29, respectively;
(g1) heavy and light chain sequences comprising SEQ ID NOs: 345 (or 346) and 30, respectively;
(g2) heavy and light chain sequences comprising SEQ ID NOs: 7 (or 14) and 30, respectively;
(g3) heavy and light chain sequences comprising SEQ ID NOs: 21 (or 28) and 30, respectively;
(g4) heavy and light chain sequences comprising SEQ ID NOs: 347 (or 348) and 30, respectively;
(h1) heavy and light chain sequences comprising SEQ ID NOs: 386 (or 387) and 408, respectively;
(h2) heavy and light chain sequences comprising SEQ ID NOs: 388 (or 389) and 408, respectively;
(h3) heavy and light chain sequences comprising SEQ ID NOs: 390 (or 391) and 408, respectively;
(h4) heavy and light chain sequences comprising SEQ ID NOs: 392 (or 393) and 408, respectively;
(i1.1) heavy and light chain sequences comprising SEQ ID NOs: 394 (or 395) and 29, respectively;
(i1.2) heavy and light chain sequences comprising SEQ ID NOs: 394 (or 395) and 409, respectively;
(i2) heavy and light chain sequences comprising SEQ ID NOs: 396 (or 397) and 29, respectively;
(i3) heavy and light chain sequences comprising SEQ ID NOs: 398 (or 399) and 29, respectively;
(i4) heavy and light chain sequences comprising SEQ ID NOs: 400 (or 401) and 29, respectively;
(i5) heavy and light chain sequences comprising SEQ ID NOs: 402 (or 403) and 29, respectively;
(i6) heavy and light chain sequences comprising SEQ ID NOs: 404 (or 405) and 29, respectively;
(i7) heavy and light chain sequences comprising SEQ ID NOs: 406 (or 407) and 29, respectively;
(j1) heavy and light chain sequences comprising SEQ ID NOs: 454 (or 463) and 33, respectively;
(j2) heavy and light chain sequences comprising SEQ ID NOs: 455 (or 464) and 33, respectively;
(k1) heavy and light chain sequences comprising SEQ ID NOs: 459 (or 467) and 33, respectively; or
(k2) heavy and light chain sequences comprising SEQ ID NOs: 460 (or 468) and 33, respectively, wherein the antibody specifically binds to human TIM3.

In some embodiments, an anti-TIM3 antibody comprises a combination of a heavy and light chain sequences set forth herein, e.g., in the preceding paragraph, wherein the antibody comprises two heavy chains and two light chains, and can further comprise at least one disulfide bond linking the two heavy chains together. The antibodies can also comprise disulfide bonds linking each of the light chains to each of the heavy chains.

Heavy and light chains comprising an amino acid sequence that is at least 99%, 98%, 97%, 96%, 95%, 90%, 85%, 80%, 75% or 70% identical to any of the heavy or light chains set forth herein (or their variable regions), e.g., SEQ ID NOs: 1-33, 72-111, 301-354, 386-409, 451, 452, 454, 455, 457, 458, 459, 460, and 461-468 can be used for forming anti-human TIM3 antibodies having the desired characteristics, e.g., those further described herein. Exemplary variants are those comprising an allotypic variation, e.g., in the constant domain, and/or a mutation in the variable or constant region, such as the mutations disclosed herein. Heavy and light chains comprising an amino acid sequence that differs in at most 1-30, 1-25, 1-20, 1-15, 1-10, 1-5, 1-4, 1-3, 1-2 or 1 amino acid (by substitution, addition or deletion) from any of the heavy or light chains set forth herein (or their variable regions) can be used for forming anti-human TIM3 antibodies having the desired characteristics, e.g., those further described herein.

In some embodiments, the antibodies described above exhibit one or more, two or more, three or more, four or more, five or more, six or more, seven or more, eight or more, nine or more, ten or more, eleven or more, twelve or more, thirteen or more, fourteen or more, fifteen or more, sixteen or more, seventeen or more, eighteen or more, nineteen or more, or all of the following functional properties:

(1) binding to soluble human TIM3, e.g., with a KD of 10 nM or less (e.g., 0.01 nM to 10 nM), e.g., as measured by Biacore, e.g., as described in the Examples;

(2) binding to soluble cynomolgus TIM3, e.g., with a KD of 100 nM or less (e.g., 0.01 nM to 100 nM), e.g., as measured by Biacore, e.g., as described in the Examples;

(3) binding to membrane bound human TIM3, e.g., with an EC50 of 1 ug/mL or less (e.g., 0.01 ug/mL to 1 ug/mL), e.g., as measured by flow cytometry (e.g., as described in the Examples);

(4) binding to membrane bound human TIM3, e.g., with a $K_D$ of 1 nM or less (e.g., 0.01 nM to 10 nM), e.g., as measured by Scatchard analysis, e.g., as described in the Examples;

(5) binding to membrane bound cynomolgus TIM3, e.g., with an EC50 of 20 ug/mL or less (e.g., 0.01 ug/mL to 20 ug/mL), e.g., as measured by flow cytometry (e.g., as described in the Examples);

(6) binding to membrane bound cynomolgus TIM3, e.g., with a $K_D$ of 1 nM or less (e.g., 0.01 nM to 10 nM), e.g., as measured by Scatchard analysis, e.g., as described in the Examples;

(7) inducing or enhancing T cell activation (e.g., by blocking or reducing the inhibitory effect of TIM3), as evidenced by (i) increased IFN-γ production in TIM3-expressing T cells (e.g., Th1 cells or TILs) and/or (ii) enhanced proliferation of TIM3-expressing T cells (e.g., Th1 cells or TILs), e.g., as described in the Examples;

(8) stimulating T cell proliferation in a mixed lymphocyte reaction (MLR) assay, e.g., as described in the Examples;

(9) inhibiting the binding of phosphatidylserine to TIM3, e.g., as measured by PS-hTIM3 "in-tandem" blocking assay, e.g., as described in the Examples;

(10) not internalizing or downregulating cell surface TIM3 when binding to TIM3 on cells;

(11) binding to one of the following regions of human TIM3 extracellular domain (SEQ ID NO: 290): (a) CPVFECG (SEQ ID NO: 296); (b) RIQIPGIMND (SEQ ID NO: 298); (c) CPVFECG and RIQIPGIMND (SEQ ID NOs: 296 and 298, respectively); and (d) WTSRYWLNGDFR (SEQ ID NO: 297), e.g., as described in the Examples;

(12) having reduced binding to human TIM3 in which one or more of amino acids L48, C58, P59, V60, F61, E62, C63, G64, W78, S80, R81, W83, L84, G86, D87, R89, D104, R111, Q113, G116, M118, and D120 (as numbered in SEQ ID NO: 286 (FIG. 25)) is substituted with another amino acid relative to binding to wildtype human TIM3, e.g., as described in the Examples;

(13) competing in either direction or both directions for binding to human TIM3 with an antibody comprising VH and VL domains of any one of 13A3, 3G4, 17C3, 17C8, 9F6, 8B9, 8C4, 14H7, 23B3, TIM3.7, TIM3.8, TIM3.10, TIM3.11, TIM3.12, TIM3.13, TIM3.14, TIM3.15, TIM3.16, TIM3.17, TIM3.18, and TIM3.25, e.g., as described in the Examples;

(14) binding to human TIM3 regions $^{49}$VPVCWGK-GACPVFE$^{62}$ (SEQ ID NO: 367) and $^{111}$RIQIPGIMNDEKFNLKL$^{127}$ (SEQ ID NO: 368) as determined by HDX-MS, e.g., as described in the Examples;

(15) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (e.g., described in the Examples; numbering per SEQ ID NO: 286 (FIG. 25));

(16) (a) having reduced binding to human TIM3 in which 1, 2, 3, 4, 5, 6, 7, 8 or 9 of amino acids C58, P59, F61, E62, C63, R111, D120, and optionally D104 and Q113 (numbering per SEQ ID NO: 286 (FIG. 25)) are substituted with another amino acid relative to binding to wildtype human TIM3; (b) binding to $^{49}$VPVCWGK-GACPVFE$^{62}$ (SEQ ID NO: 367), $^{111}$RIQIPGIMNDEKFNLKL$^{127}$ (SEQ ID NO: 368) and $^{119}$NDEKFNLKL$^{127}$ (SEQ ID NO: 373), as determined by HDX-MS, as described in the Examples; and/or (c) competing with or cross-blocking with the binding to human TIM3 of 13A3 or TIM3.18.IgG1.3, e.g., as described in the Examples

(17) binding to hTIM3-IgV with a $K_D$ of $5 \times 10^{-8}$ M, $2 \times 10^{-8}$ M, $10^{-8}$ M or $5 \times 10^{-9}$ M or less, as determined by the method described in Example 22;

(18) binding to hTIM3-IgV with a $K_D$ of $10^{-8}$ M, $2 \times 10^{-8}$ M or $10^{-8}$ M or less, as determined by the method described in Example 22;

(19) binding to cynoTIM3-ECD with a $K_D$ of $5 \times 10^{-7}$ M, $2 \times 10^{-8}$ M or $10^{-8}$ M or less, as determined by the method described in Example 22; and/or

(20) binding to hTIM3-ECD with a $K_D$ of $8 \times 10^{-8}$ M, $5 \times 10^{-8}$ M or $10^{-8}$ M or less, as determined by the method described in Example 22.

Such antibodies include, for example, human antibodies, humanized antibodies, or chimeric antibodies.

In some embodiments, anti-TIM3 antibodies described herein bind to a conformational epitope.

In some embodiments, anti-TIM3 antibodies described herein bind to amino acid residues within the following region of mature human TIM3 extracellular domain (SEQ ID NO: 290): SEVEYRAEVGQNAYLPCFYT-PAAPGNLVPVCWGKGACPVFECGNVVLRTDER-DVNYWTSRYWLNGDFRKGDVSLT IENVT-LADSGIYCCRIQIPGIMND (SEQ ID NO: 299), corresponding to amino acid residues 1-99 of mature human TIM3 extracellular domain (SEQ ID NO: 290) or amino acids 22 to 120 of human TIM3 having SEQ ID NO: 286.

In some embodiments, anti-TIM3 antibodies described herein bind to amino acid residues within the following region of mature human TIM3 extracellular domain (SEQ ID NO: 290): CPVFECG (SEQ ID NO: 296), corresponding to amino acid residues 3743 of mature human TIM3 extracellular domain (SEQ ID NO: 290).

In some embodiments, anti-TIM3 antibodies described herein bind to amino acid residues within the following region of mature human TIM3 extracellular domain (SEQ ID NO: 290): WTSRYWLNGDFR (SEQ ID NO: 297), corresponding to amino acid residues 57-83 of mature human TIM3 extracellular domain (SEQ ID NO: 290).

In some embodiments, anti-TIM3 antibodies described herein bind to amino acid residues within the following region of mature human TIM3 extracellular domain (SEQ ID NO: 290): RIQIPGIMND (SEQ ID NO:298), corresponding to amino acid residues 90-99 of mature human TIM3 extracellular domain (SEQ ID NO: 290).

In some embodiments, anti-TIM3 antibodies have the same pattern of binding to wildtype and mutated human TIM3 as that of one or more of antibodies 13A3, 3G4, 17C3, 17C8, 9F6, 8B9, 8C4, 14H7, 23B3, and TIM3.2 to TIM3.18, TIM3.24, and TIM3.25. In some embodiments, an anti-TIM3 antibody binds to amino acid residues within the following regions of mature human TIM3 extracellular domain (SEQ ID NO: 290): CPVFECG (SEQ ID NO: 296), WTSRYWLNGDFRKGDVSLTIENVTLAD (SEQ ID NO: 297), and/or RIQIPGIMND (SEQ ID NO: 298).

In some embodiments, an anti-TIM3 antibody binds to (1) $^{49}$VPVCWGKGACPVFE$^{62}$ (SEQ ID NO: 367) and $^{111}$RIQIPGIMNDEKFNLKL$^{127}$ (SEQ ID NO: 368) or (2) $^{40}$YTPAAPGNLVPVCWGKGACPVFE$^{62}$ (SEQ ID NO: 369), $^{66}$VVLRTDERDVNY$^{77}$ (SEQ ID NO: 370), $^{78}$WTSRYWLNGDFRKGDVSL$^{95}$ (SEQ ID NO: 371), $^{110}$CRIQIPGIMNDEKFNLKL$^{127}$ (SEQ ID NO: 372), and $^{119}$MEKFNLKL$^{127}$ (SEQ ID NO: 373), as determined by HDX-MS, as described, e.g., in the Examples. In some embodiments, an anti-TIM3 antibody interacts with regions of amino acid residues 40-62 and 111-127 of hTIM3, but does not significantly interact with other regions, such as the region that is N-terminal to amino acid residue Y40, the region that is located between amino acid residues E62 and R11, and the region that is C-terminal to amino acid residue L127, as determined by HDX-MS, as described, e.g., in the Examples.

In some embodiments, an anti-TIM3 antibody has reduced binding to human TIM3 in which one or more of amino acids L48, C58, P59, V60, F61, E62, C63, G64, W78, S80, R81, W83, L84, G86, D87, R89, D104, R111, Q113, G116, M118, and D120 (as numbered in SEQ ID NO: 286 (FIG. 25)) is substituted with another amino acid relative to binding to wildtype human TIM3 and the antibody binds to (1) $^{49}$VPVCWGKGACPVFE$^{62}$ (SEQ ID NO: 367) and $^{111}$RIQIPGIMNDEKFNLKL$^{127}$ (SEQ ID NO: 368) or (2) $^{40}$YTPAAPGNLVPVCWGKGACPVFE$^{62}$ (SEQ ID NO: 369), $^{66}$VVLRTDERDVNY$^{77}$ (SEQ ID NO: 370), $^{78}$WTSRYWLNGDFRKGDVSL$^{95}$ (SEQ ID NO: 371), $^{110}$CRIQIPGIMNDEKFNLKL$^{127}$ (SEQ ID NO: 372), and $^{119}$NDEKFNLKL$^{127}$ (SEQ ID NO: 373), as determined by HDX-MS, as described, e.g., in the Examples.

In some embodiments, an anti-TIM3 antibody has a similar pattern of binding to wild-type and mutated human TIM3 as that of TIM3.18.IgG1.3 or 13A3, i.e., the antibody:

(i) binds to (1) $^{49}$VPVCWGKGACPVFE$^{62}$ (SEQ ID NO: 367), $^{111}$RIQIPGIMNDEKFNLKL$^{127}$ (SEQ ID NO: 368), and $^{119}$NDEKFNLKL$^{127}$ (SEQ ID NO: 373), and, e.g., but does not bind significantly to (a) peptides having sequences located N-terminal of amino acid residue 49; (b) peptides having sequences located between amino acid residue 62 and 11I (e.g., $^{78}$WTSRYWLNGDFRKGDVSL$^{95}$ (SEQ ID NO: 371)); and (c) peptides having sequences that are located C-terminal of amino acid residue 127, as determined by HDX-MS (e.g., as described in the Examples);

(ii) fails to bind to human TIM3, or has significantly reduced binding to human TIM3, having one or more of the following amino acid mutations, as determined, e.g., using a yeast surface display method (e.g., as described in the Examples): C58, P59, F61, E62, C63, R111, D120, and optionally D104 and Q113 (numbering per SEQ ID NO: 286 (FIG. 25)); and/or (iii) has the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (e.g., as described in the Examples; numbering per SEQ ID NO: 286 (FIG. 25)).

In some embodiments, an anti-TIM3 antibody comprises a heavy chain and a light chain, wherein the heavy chain is selected from the group consisting of SEQ ID NOs: 72-111, 305-320, 325-326, 339-340, 349-354, 402-407, 451, 452, 454, 455, 457, 458, 459, 460, and 461-468 and/or the light chain is selected from the group consisting of SEQ ID NOs: 29-33.

As further discussed herein, the heavy chain constant region of anti-TIM3 antibodies described herein can be of any isotype, e.g., IgG1, IgG2, IgG3 and IgG4, or combinations thereof and/or modifications thereof. An anti-TIM3 antibody can have effector function or can have reduced or no effector function. In some embodiments, anti-TIM3 antibodies comprise a modified heavy chain constant region that provides enhanced properties to the antibody.

In some embodiments, an anti-TIM3 antibody comprises a heavy chain and an light chain, wherein the heavy chain is selected from the group consisting of SEQ ID NOs: 72-111, 349-352, 402-405, 451, 452, 454, 455, 457, 458, 459, 460, and 461-468, and/or the light chain is selected from the group consisting of SEQ ID NOs: 29-33.

III. Antibodies Having Particular Germline Sequences

In some embodiments, an anti-TIM3 antibody comprises a heavy chain variable region from a particular germline heavy chain immunoglobulin gene and/or a light chain variable region from a particular germline light chain immunoglobulin gene.

As demonstrated herein, human antibodies specific for TIM3 have been prepared that comprise a heavy chain variable region that is the product of or derived from a human germline VH 4-39 gene, VH 4-59 gene, VH 1-46 gene, VH 3-11, VH 4-17 gene, VH 3-10 gene, VH 6-19 gene, VH 6-13 gene, VH 4-23, VH JH4b, VH JH5b gene and/or VH JH6b gene. Accordingly, provided herein are isolated monoclonal antibodies, or antigen binding portions thereof, comprising a heavy chain variable region that is the product of or derived from a human VH germline gene selected from the group consisting of: VH 4-39, VH 4-59, VH 1-46, VH 3-11, VH 4-17, VH 3-10, VH6-19, VH 6-13, VH 4-23, VH JH4b, VH JH5b, VH JH6b, and any combination thereof.

Human antibodies specific for TIM3 have been prepared that comprise a light chain variable region that is the product of or derived from a human germline VK A27 gene, VK JK5 gene, VK JK4 gene, VK JK3, VK L18 gene, and/or VK JK1 gene. Accordingly, provide herein are isolated monoclonal antibodies, or antigen binding portions thereof, comprising a light chain variable region that is the product of or derived from a human VK germline gene selected from the group consisting of: VK A27, VK JK5, VK JK4, VK JK3, VK L 18, VK JK1, and any combination thereof.

Anti-TIM3 antibodies described herein include those comprising a heavy chain variable region that is the product of or derived from one of the above-listed human germline VH genes and also comprising a light chain variable region that is the product of or derived from one of the above-listed human germline VK genes, as shown in the Figures.

As used herein, a human antibody comprises heavy and light chain variable regions that are "the product of or "derived from" a particular germline sequence if the variable regions of the antibody are obtained from a system that uses human germline immunoglobulin genes. Such systems include immunizing a transgenic mouse carrying human immunoglobulin genes with the antigen of interest or screening a human immunoglobulin gene library displayed on phage with the antigen of interest. A human antibody that is "the product of or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of or "derived from" a particular human germline immunoglobulin sequence can contain amino acid differences as compared to the germline sequence, due to, for example, naturally-occurring somatic mutations or intentional introduction of site-directed mutation. However, a selected human antibody typically is at least 90% identical in amino acids sequence to an amino acid sequence encoded by a human germline immunoglobulin gene and contains amino acid residues that identify the human antibody as being human when compared to the germline immunoglobulin amino acid sequences of other species (e.g., murine germline sequences). In some cases, a human antibody can be at least 95%, or even at least 96%, 97%, 98%, or 99% identical in amino acid sequence to the amino acid sequence encoded by the germline immunoglobulin gene. Typically, a human antibody derived from a particular human germline sequence will display no more than 10 amino acid differences from the amino acid sequence encoded by the human germline immunoglobulin gene. In certain cases, the human antibody can display no more than 5, or even no more than 4, 3, 2, or 1 amino acid difference from the amino acid sequence encoded by the germline immunoglobulin gene.

IV. Homologous Antibodies

Encompassed herein are antibodies having heavy and light chain variable regions comprising amino acid sequences that are homologous to the amino acid sequences of the anti-TIM3 antibodies described herein, and wherein the antibodies retain the desired functional properties of the anti-TIM3 antibodies described herein.

For example, an isolated anti-TIM3 antibody, or antigen binding portion thereof, can comprise a heavy chain variable region and a light chain variable region, wherein:
 (a) the heavy chain variable region comprises an amino acid sequence that is at least 80%, 85%, 90%, 95%, 96%, 97%, 98% or 99% identical to an amino acid sequence selected from the group consisting of SEQ ID NOs: 34-40, 112-121, 364, and 410-412, or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 34-40, 112-121, 364, and 410-412, wherein optionally the heavy chain variable region comprises the CDR sequences of one of the anti-TIM3 antibodies described herein;
 (b) the light chain variable region comprises an amino acid sequence that is at least 80%, 85%, 90%, 95%, 96%, 97%, 98% or 99% identical to an amino acid sequence selected from the group consisting of SEQ ID NOs: 60-63, 417, and 418, or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 60-63, 417, and 418, wherein optionally the light chain variable region comprises the CDR sequences of one of the anti-TIM3 antibodies described herein;
 (c) the antibody specifically binds to human TIM3, and
 (d) the antibody exhibits 1, 2, 3, 4, 5, 6, 7, 8, 9, 10, 11, 12, 13, 14, 15, 17, 18, 19, or all of the following functional properties:
 (1) binding to soluble human TIM3, e.g., with a $K_D$ of 10 nM or less (e.g., 0.01 nM to 10 nM), e.g., as measured by Biacore, e.g., as described in the Examples;
 (2) binding to soluble cynomolgus TIM3, e.g., with a $K_D$ of 100 nM or less (e.g., 0.01 nM to 100 nM), e.g., as measured by Biacore, e.g., as described in the Examples;
 (3) binding to membrane bound human TIM3, e.g., with an $EC_{50}$ of 1 ug/mL or less (e.g., 0.01 ug/mL to 1 ug/mL), e.g., as measured by flow cytometry (e.g., as described in the Examples);
 (4) binding to membrane bound human TIM3, e.g., with a $K_D$ of 1 nM or less (e.g., 0.01 nM to 10 nM), e.g., as measured by Scatchard analysis, e.g., as described in the Examples;
 (5) binding to membrane bound cynomolgus TIM3, e.g., with an $EC_{50}$ of 20 ug/mL or less (e.g., 0.01 ug/mL to 20 ug/mL), e.g., as measured by flow cytometry (e.g., as described in the Examples);
 (6) binding to membrane bound cynomolgus TIM3, e.g., with a $K_D$ of 1 nM or less (e.g., 0.01 nM to 10 nM), e.g., as measured by Scatchard analysis, e.g., as described in the Examples;
 (7) inducing or enhancing T cell activation (e.g., by blocking or reducing the inhibitory effect of TIM3), as evidenced by (i) increased IFN-γ production in TIM3-expressing T cells (e.g., Th1 cells or TILs) and/or (ii) enhanced proliferation of TIM3-expressing T cells (e.g., Th1 cells or TILs), e.g., as described in the Examples;
 (8) stimulating T cell proliferation in a mixed lymphocyte reaction (MLR) assay, e.g., as described in the Examples;
 (9) inhibiting the binding of phosphatidylserine to TIM3, e.g., as measured by PS-hTIM3 "in-tandem" blocking assay, e.g., as described in the Examples;
 (10) not internalizing or downregulating cell surface TIM3 when binding to TIM3 on cells;
 (11) binding to one of the following regions of human TIM3 extracellular domain (SEQ ID NO: 290): (a) CPVFECG (SEQ ID NO: 296); (b) RIQIPGIMND (SEQ ID NO: 298); (c) CPVFECG and RIQIPGIMND (SEQ ID NOs: 296 and 298, respectively); and (d) WTSRYWLNGDFR (SEQ ID NO: 297), e.g., as described in the Examples;
 (12) having reduced binding to human TIM3 in which one or more of amino acids L48, C58, P59, V60, F61, E62, C63, G64, W78, S80, R81, W83, L84, G86, D87, R89, D104, R111, Q113, G116, M118, and D120 (as numbered in SEQ ID NO: 286 (FIG. 25)) is substituted with another amino acid relative to binding to wildtype human TIM3, e.g., as described in the Examples;
 (13) competing in either direction or both directions for binding to human TIM3 with an antibody comprising VH and VL domains of any one of 13A3, 3G4, 17C3, 17C8, 9F6, 8B9, 8C4, 14H7, 23B3, or TIM3.7, TIM3.8, TIM3.10, TIM3.11, TIM3.12, TIM3.13, TIM3.14, TIM3.15, TIM3.16, TIM3.17, TIM3.18, TIM3.20, TIM3.21, TIM3.22, TIM3.23, and TIM3.25, e.g., as described in the Examples;
 (14) binding to human TIM3 regions "VPVCWGK-GACPVFE$^{62}$ (SEQ ID NO: 367) and $^{111}$RIQIPGIMNDEKFNLKL$^1$'" (SEQ ID NO: 368) as determined by HDX-MS, e.g., as described in the Examples;
(15) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (e.g., described in the Examples; numbering per SEQ ID NO: 286 (FIG. 25));
(16) (a) having reduced binding to human TIM3 in which 1, 2, 3, 4, 5, 6, 7, 8 or 9 of amino acids C58, P59, F61, E62, C63, R111, D120, and optionally D104 and Q113 (numbering per SEQ ID NO: 286 (FIG. 25)) are substituted with another amino acid relative to binding to wildtype human TIM3; (b) binding to $^{49}$VPVCWGK-GACPVFE$^{62}$ (SEQ ID NO: 367), $^{111}$RIQIPGIMNDEKFNLKL$^{127}$ (SEQ ID NO: 368) and $^{119}$NDEKFNLKL$^{127}$ (SEQ ID NO: 373), as determined by HDX-MS, as described in the Examples; and/or (c) competing with or cross-blocking with the binding to human TIM3 of 13A3 or TIM3.18.IgG1.3, e.g., as described in the Examples;
(17) binding to hTIM3-IgV with a $K_D$ of $5\times10^{-8}$ M, $2\times10^{-8}$ M, $10^{-8}$ M or $5\times10^{-9}$ M or less, as determined by the method described in Example 22;
(18) binding to hTIM3-IgV with a $K_D$ of $10^{-8}$ M, $2\times10^{-8}$ M or $10^{-8}$ M or less, as determined by the method described in Example 22;
(19) binding to cynoTIM3-ECD with a $K_D$ of $5\times10^{-7}$ M, $2\times10^{-8}$ M or $10^{-8}$ M or less, as determined by the method described in Example 22; and/or
(20) binding to hTIM3-ECD with a $K_D$ of $8\times10^{-8}$ M, $5\times10^{-8}$ M or $10^{-8}$ M or less, as determined by the method described in Example 22.

In some embodiments, the antibody can exhibit one or more, two or more, three or more, four or more, five or more, six or more, seven or more, eight or more, nine or more, or all of the functional properties listed as (1) through (20) above. The antibody can be, for example, a human antibody, a humanized antibody or a chimeric antibody.

An isolated anti-TIM3 antibody, or antigen binding portion thereof, can comprise a heavy chain and a light chain, wherein:
(a) the heavy chain comprises an amino acid sequence that is at least 80%, 85%, 90%, 95%, 96%, 97%, 98% or 99% identical to an amino acid sequence selected from the group consisting of SEQ ID NOs: 1-28, 72-111, and 349-352, 388-391 (14H7/TIM3.24 HC IgG1.1f and IgG1.3f), 396-399 (23B3 HC IgG1.1f and IgG1.3f), 402-405 (TIM3.25 HC IgG1f and IgG1.3f), 451, 452, 461, 462 (TIM3.20 HC IgG1f and IgG1.3f), 454, 455, 463, 464 (TIM3.21 HC IgG1f and IgG1.3f), 457, 458, 465, 466 (TIM3.22 HC IgG1f and IgG1.3f), and 459, 460, 467, 468 (TIM3.23 HC IgG1f and IgG1.3f), or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 1-28, 72-111, 349-352, 388-391 (14H7/TIM3.24 HC IgG1.1f and IgG1.3f), 396-399 (23B3 HC IgG1.1f and IgG1.3f), 402-405 (TIM3.25 HC IgG1f and IgG1.3f), 451, 452, 461, 462 (TIM3.20 HC IgG1.1f and IgG1.3f), 454, 455, 463, 464 (TIM3.21 HC IgG1f and IgG1.3f), 457, 458, 465, 466 (TIM3.22 HC IgG1f and IgG1.3f), and 459, 460, 467, 468 (TIM3.23 HC IgG1f and IgG1.3f), with the proviso that, in some embodiments, if the sequence is that of an effectorless heavy chain, the mutations rendering the heavy chain effectorless are not modified (e.g., no modification is made to R214, A234, E235, A237, S330 and S331) for IgG1.1 constant regions, and no modification is made to R214, A234 and E235 for IgG1.3 constant regions, wherein optionally the heavy chain variable region comprises the CDR sequences of one of the anti-TIM3 antibodies described herein;
(b) the light chain comprises an amino acid sequence that is at least 80%, 85%, 90%, 95%, 96%, 97%, 98% or 99% identical to an amino acid sequence selected from the group consisting of SEQ ID NOs: 29-33, 408, and 409, or comprises 1, 2, 3, 4, 5, 1-2, 1-3, 1-4, 1-5, 1-10, 1-15, 1-20, 1-25, or 1-50 amino acid changes (i.e., amino acid substitutions, additions or deletions) relative to an amino acid sequence selected from the group consisting of SEQ ID NOs: 29-33, 408, and 409, wherein optionally the light chain variable region comprises the CDR sequences of one of the anti-TIM3 antibodies described herein;
(c) the antibody specifically binds to human TIM3, and
(d) the antibody exhibits 1, 2, 3, 4, 5, 6, 7, 8, 9, 10, 11, 12, 13, 14, 15, 16, 17, 18, 19, or all of the following functional properties:
(1) binding to soluble human TIM3, e.g., with a $K_D$ of 10 nM or less (e.g., 0.01 nM to 10 nM), e.g., as measured by Biacore, e.g., as described in the Examples;
(2) binding to soluble cynomolgus TIM3, e.g., with a $K_D$ of 100 nM or less (e.g., 0.01 nM to 100 nM), e.g., as measured by Biacore, e.g., as described in the Examples;
(3) binding to membrane bound human TIM3, e.g., with an $EC_{50}$ of 1 ug/mL or less (e.g., 0.01 ug/mL to 1 ug/mL), e.g., as measured by flow cytometry (e.g., as described in the Examples);
(4) binding to membrane bound human TIM3, e.g., with a $K_D$ of 1 nM or less (e.g., 0.01 nM to 10 nM), e.g., as measured by Scatchard analysis, e.g., as described in the Examples;
(5) binding to membrane bound cynomolgus TIM3, e.g., with an $EC_{50}$ of 20 ug/mL or less (e.g., 0.01 ug/mL to 20 ug/mL), e.g., as measured by flow cytometry (e.g., as described in the Examples);
(6) binding to membrane bound cynomolgus TIM3, e.g., with a $K_D$ of 1 nM or less (e.g., 0.01 nM to 10 nM), e.g., as measured by Scatchard analysis, e.g., as described in the Examples;
(7) inducing or enhancing T cell activation (e.g., by blocking or reducing the inhibitory effect of TIM3), as evidenced by (i) increased IFN-γ production in TIM3-expressing T cells (e.g., Th1 cells or TILs) and/or (ii) enhanced proliferation of TIM3-expressing T cells (e.g., Th1 cells or TILs), e.g., as described in the Examples;
(8) stimulating T cell proliferation in a mixed lymphocyte reaction (MLR) assay, e.g., as described in the Examples;
(9) inhibiting the binding of phosphatidylserine to TIM3, e.g., as measured by PS-hTIM3 "in-tandem" blocking assay, e.g., as described in the Examples;
(10) not internalizing or downregulating cell surface TIM3 when binding to TIM3 on cells;
(11) binding to one of the following regions of human TIM3 extracellular domain (SEQ ID NO: 290): (a) CPVFECG (SEQ ID NO: 296); (b) RIQIPGIMND (SEQ ID NO: 298); (c) CPVFECG and RIQIPGIMND (SEQ ID NOs: 296 and 298, respectively); and (d) WTSRYWLNGDFR (SEQ ID NO: 297), e.g., as described in the Examples;

(12) having reduced binding to human TIM3 in which one or more of amino acids L48, C58, P59, V60, F61, E62, C63, G64, W78, S80, R81, W83, L84, G86, D87, R89, D104, R111, Q113, G116, M118, and D120 (as numbered in SEQ ID NO: 286 (FIG. 25)) is substituted with another amino acid relative to binding to wildtype human TIM3, e.g., as described in the Examples;

(13) competing in either direction or both directions for binding to human TIM3 with an antibody comprising VH and VL domains of any one of 13A3, 3G4, 17C3, 17C8, 9F6, 8B9, 8C4, 14H7, 23B3, TIM3.7, TIM3.8, TIM3.10, TIM3.11, TIM3.12, TIM3.13, TIM3.14, TIM3.15, TIM3.16, TIM3.17, TIM3.18, and TIM3.25, e.g., as described in the Examples;

(14) binding to human TIM3 regions $^{49}$VPVCWGKGACPVFE$^{62}$ (SEQ ID NO: 367) and $^{111}$RIQIPGIMNDEKFNLKL$^{127}$ (SEQ ID NO: 368) as determined by HDX-MS, e.g., as described in the Examples;

(15) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (e.g., described in the Examples; numbering per SEQ ID NO: 286 (FIG. 25));

(16) (a) having reduced binding to human TIM3 in which 1, 2, 3, 4, 5, 6, 7, 8 or 9 of amino acids C58, P59, F61, E62, C63, R111, D120, and optionally D104 and Q113 (numbering per SEQ ID NO: 286 (FIG. 25)) are substituted with another amino acid relative to binding to wildtype human TIM3; (b) binding to $^{49}$VPVCWGKGACPVFE$^{62}$ (SEQ ID NO: 367), $^{111}$RIQIPGIMNDEKFNLKL$^{127}$ (SEQ ID NO: 368) and $^{119}$NDEKFNLKL$^{127}$ (SEQ ID NO: 373), as determined by HDX-MS, as described in the Examples; and/or (c) completing with or cross-blocking with the binding to human TIM3 of 13A3 or TIM3.18.IgG1.3, e.g., as described in the Examples (17) binding to hTIM3-IgV with a $K_D$ of $5\times10^{-8}$ M, $2\times10^{-8}$ M, $10^{-8}$ M or $5\times10^{-9}$ M or less, as determined by the method described in Example 22;

(18) binding to hTIM3-IgV with a $K_D$ of $10^{-7}$ M, $2\times10^{-8}$ M or $10^{-8}$ M or less, as determined by the method described in Example 22;

(19) binding to cynoTIM3-ECD with a $K_D$ of $5\times10^{-7}$ M, $2\times10^{-8}$ M or $10^{-8}$ M or less, as determined by the method described in Example 22; and/or

(20) binding to hTIM3-ECD with a $K_D$ of $8\times10^{-8}$ M, $5\times10^{-8}$ M or $10^{-8}$ M or less, as determined by the method described in Example 22.

Also provided are anti-TIM3 antibodies comprising a VH CDR1, VH CDR2, VH CDR3, VL CDR1, VL CDR2, and/or VL CDR3 that differs from the corresponding CDR of 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 in 1, 2, 3, 4, 5, 1-2, 1-3, 1-4, or 1-5 amino acid changes (i.e., amino acid substitutions, additions or deletions). In some embodiments, an anti-TIM3 antibody comprises 1-5 amino acid changes in each of 1, 2, 3, 4, 5 or 6 of the CDRs relative to the corresponding sequence in 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25. In some embodiments, an anti-TIM3 antibody comprises at total of 1-5 amino acid changes across all CDRs relative to the CDRs in 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25.

In some embodiments, an anti-TIM3 antibody comprises VH and VL CDRs consisting of those of 13A3, wherein one or more of the amino acids in one or more CDRs are those of one of the other anti-TIM3 antibodies disclosed herein.

For example, in some embodiments, an anti-TIM3 antibody comprises a VH CDR1 comprising one or more amino acid modifications relative to SRSYYWG (SEQ ID NO: 41), and can comprise, e.g., the following degenerate sequence: $X_1X_2X_3X_4YX_5X_6$ (SEQ ID NO: 282), wherein $X_1$ is any amino acid, e.g., S or none; $X_2$ is any amino acid, e.g., R or none; $X_3$ is any amino acid, e.g., S, R, or D; $X_4$ is any amino acid, e.g., Y or H; $X_5$ is any amino acid, e.g., W or M; and $X_6$ is any amino acid, e.g., G, N, S, or H.

In some embodiments, an anti-TIM3 antibody comprises a VH CDR2 comprising one or more amino acid modifications relative to SIYYSGFTYYNPSLKS (SEQ ID NO: 46), and can comprise, e.g., the following degenerate sequence: $X_1IX_2X_3X_4GX_5X_6X_7X_8YX_9X_{10}X_{11}X_{12}X_{13}X_{14}$ (SEQ ID NO: 283), wherein $X_1$ is any amino acid, e.g., S, Y, I, or F; $X_2$ is any amino acid, e.g., Y, H, N, or S; X3 is any amino acid, e.g., Y, P, G, T, S, or N; X4 is any amino acid, e.g., S, T, R, or G; X5 is any amino acid, e.g., F, S, or D; X6 is any amino acid, e.g., S, T, or I; X7 is any amino acid, e.g., I or none; X8 is any amino acid, e.g., Y, N, or I; X9 is any amino acid, e.g., N, Q, S, or A; X10 is any amino acid, e.g., P, S, Q, or D; X11 is any amino acid, e.g., S or K; X12 is any amino acid, e.g., L, F, or V; X13 is any amino acid, e.g., K or Q; and X14 is any amino acid, e.g., S or G.

In some embodiments, an anti-TIM3 antibody comprises a VH CDR3 comprising one or more amino acid modifications relative to GGPYGDYAHWFDP (SEQ ID NO: 53), and can comprise, e.g., the following degenerate sequence: $X_1X_2X_3X_4X_5X_6X_7X_8X_9X_{10}X_{11}X_{12}X_{13}X_{14}X_{15}X_{16}X_{17}X_{18}X_{19}X_{20}$ (SEQ ID NO: 284), wherein $X_1$ is any amino acid, e.g., D, E, G, or none; $X_2$ is any amino acid, e.g., F, G, R, or none; X3 is any amino acid, e.g., Y, M, I or none; X4 is any amino acid, e.g., G, S, V, or none; X5 is any amino acid, e.g., G, T, R, S, or none; X6 is any amino acid, e.g., G, S, or none; X7 is any amino acid, e.g., M, N, W, or none; X8 is any amino acid, e.g., Y, S, E, N, or none; X9 is any amino acid, e.g., Y or none; X10 is any amino acid, e.g., F, P or Y; X11 is any amino acid, e.g., Y or F; X12 is any amino acid, e.g., G or none; X13 is any amino acid, e.g., D or none; X14 is any amino acid, e.g., Y or none; X15 is any amino acid, e.g., A or none; X16 is any amino acid, e.g., H or none; X17 is any amino acid, e.g., W or none; X18 is any amino acid, e.g., F, M, or none; X19 is any amino acid, e.g., D or E; and X20 is any amino acid, e.g., P, I, V, Y, or L.

In some embodiments, an anti-TIM3 antibody comprises a VL CDR1 comprising an amino acid sequence as set forth in SEQ ID NO: 64 or SEQ ID NO: 65.

In some embodiments, an anti-TIM3 antibody comprises a VL CDR2 comprising an amino acid sequence as set forth in SEQ ID NO: 66 or SEQ ID NO: 67.

In some embodiments, an anti-TIM3 antibody comprises a VL CDR3 comprising one or more amino acid modifications relative to QQYGSSPIT (SEQ ID NO: 68), and can comprise, e.g., the following degenerate sequence: $QQX_1X_2SX_3X_4X_5X_6$ (SEQ ID NO: 285), wherein $X_1$ is any amino acid, e.g., F or Y; $X_2$ is any amino acid, e.g., N or G; $X_3$ is any amino acid, e.g., Y or S; $X_4$ is any amino acid, e.g., P or none; $X_5$ is any amino acid, e.g., I, R, L, or none; $X_6$ is any amino acid, e.g., T or none.

Antibodies having sequences with homology to those of 13A3, 8B9, 8C4, 17C3, 9F6, 3G4, 8C4, 14H7, 23B3, or any of TIM3.2 to TIM3.18, TIM3.20, TIM3.21, TIM3.22, TIM3.23, TIM3.24, and TIM3.25, e.g., the VH and VL regions of SEQ ID NOs: 34-40, 112-121, 364, and 410-412, and SEQ ID NOs: 60-63, 417, and 418, respectively, or heavy and light chains of SEQ ID NOs: 1-28, 72-111, 349-352, 388-391, 396-399, or 402-405, and SEQ ID NOs: 29-33, 408, or 409, respectively, or CDRs, can be obtained by mutagenesis (e.g., site-directed or PCR-mediated mutagenesis) of nucleic acid molecules encoding SEQ ID NOs: 167-173 and/or SEQ ID NOs: 193-196 or SEQ ID NOs: 134-161, 430-437 and/or SEQ ID NOs: 162-166 and 442-444, followed by testing of the encoded altered antibody for retained function (i.e., the functions set forth in (1) through (16) above) using the functional assays described herein.

V. Antibodies M Conservative Modifications

Anti-TIM3 antibodies can comprise a heavy chain variable region comprising CDR1, CDR2 and CDR3 sequences and a light chain variable region comprising CDR1, CDR2 and CDR3 sequences, wherein one or more of these CDR sequences comprise specified amino acid sequences based on the anti-TIM3 antibodies described herein (e.g., 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25), or conservative modifications thereof, and wherein the antibodies retain the desired functional properties of the anti-TIM3 antibodies described herein. Accordingly, an isolated anti-TIM3 antibody, or antigen binding portion thereof, can comprise a heavy chain variable region comprising CDR1, CDR2, and CDR3 sequences and a light chain variable region comprising CDR1, CDR2, and CDR3 sequences, wherein:

(a) the heavy chain variable region CDR3 sequence comprises an amino acid sequence selected from the group consisting of amino acid sequences of SEQ ID NOs: 53-59, 126-129, 414, and 416, and conservative modifications thereof, e.g., 1, 2, 3, 4, 5, 1-2, 1-3, 1-4 or 1-5 conservative amino acid substitutions, wherein optionally the heavy chain variable region comprises the CDR sequences of one of the anti-TIM3 antibodies described herein;

(b) the light chain variable region CDR3 sequence comprises an amino acid sequence selected from the group consisting of amino acid sequence of SEQ ID NOs: 68-71, and 419, and conservative modifications thereof, e.g., 1, 2, 3, 4, 5, 1-2, 1-3, 1-4 or 1-5 conservative amino acid substitutions, wherein optionally the light chain variable region comprises the CDR sequences of one of the anti-TIM3 antibodies described herein;

(c) the antibody specifically binds to human TIM3, and (d) the antibody exhibits 1, 2, 3, 4, 5, 6, 7, 8, 9, 10, 11, 12, 13, 14, 15, 16, 17, 18, 19, or all of the following features:

(1) binding to soluble human TIM3, e.g., with a $K_D$ of 10 nM or less (e.g., 0.01 nM to 10 nM), e.g., as measured by Biacore, e.g., as described in the Examples;

(2) binding to soluble cynomolgus TIM3, e.g., with a $K_D$ of 100 nM or less (e.g., 0.01 nM to 100 nM), e.g., as measured by Biacore, e.g., as described in the Examples;

(3) binding to membrane bound human TIM3, e.g., with an $EC_{50}$ of 1 ug/mL or less (e.g., 0.01 ug/mL to 1 ug/mL), e.g., as measured by flow cytometry (e.g., as described in the Examples);

(4) binding to membrane bound human TIM3, e.g., with a $K_D$ of 1 nM or less (e.g., 0.01 nM to 10 nM), e.g., as measured by Scatchard analysis, e.g., as described in the Examples;

(5) binding to membrane bound cynomolgus TIM3, e.g., with an $EC_{50}$ of 20 ug/mL or less (e.g., 0.01 ug/mL to 20 ug/mL), e.g., as measured by flow cytometry (e.g., as described in the Examples);

(6) binding to membrane bound cynomolgus TIM3, e.g., with a $K_D$ of 1 nM or less (e.g., 0.01 nM to 10 nM), e.g., as measured by Scatchard analysis, e.g., as described in the Examples;

(7) inducing or enhancing T cell activation (e.g., by blocking or reducing the inhibitory effect of TIM3), as evidenced by (i) increased IFN-γ production in TIM3-expressing T cells (e.g., Th1 cells or TILs) and/or (ii) enhanced proliferation of TIM3-expressing T cells (e.g., Th1 cells or TILs), e.g., as described in the Examples;

(8) stimulating T cell proliferation in a mixed lymphocyte reaction (MLR) assay, e.g., as described in the Examples;

(9) inhibiting the binding of phosphatidylserine to TIM3, e.g., as measured by PS-hTIM3 "in-tandem" blocking assay, e.g., as described in the Examples;

(10) not internalizing or downregulating cell surface TIM3 when binding to TIM3 on cells;

(11) binding to one of the following regions of human TIM3 extracellular domain (SEQ ID NO: 290): (a) CPVFECG (SEQ ID NO: 296); (b) RIQIPGIMND (SEQ ID NO: 298); (c) CPVFECG and RIQIPGIMND (SEQ ID NOs: 296 and 298, respectively); and (d) WTSRYWLNGDFR (SEQ ID NO: 297), e.g., as described in the Examples;

(12) having reduced binding to human TIM3 in which one or more of amino acids L48, C58, P59, V60, F61, E62, C63, G64, W78, S80, R81, W83, L84, G86, D87, R89, D104, R111, Q113, G116, M118 and D120 (as numbered in SEQ ID NO: 286 (FIG. 25)) is substituted with another amino acid relative to binding to wildtype human TIM3, e.g., as described in the Examples;

(13) competing in either direction or both directions for binding to human TIM3 with an antibody comprising VH and VL domains of any one of 13A3, 3G4, 17C3, 17C8, 9F6, 8B9, 8C4, 14H7, 23B3, or TIM3.7, TIM3.8, TIM3.10, TIM3.11, TIM3.12, TIM3.13, TIM3.14, TIM3.15, TIM3.16, TIM3.17, TIM3.18, TIM3.20, TIM3.21, TIM3.22, TIM3.23, and TIM3.25, e.g., as described in the Examples;

(14) binding to human TIM3 regions $^{49}$VPVCWGKGACPVFE$^{62}$ (SEQ ID NO: 367) and $^{111}$RIQIPGIMNDEKFNLKL$^{127}$ (SEQ ID NO: 368) as determined by HDX-MS, e.g., as described in the Examples;

(15) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (e.g., described in the Examples; numbering per SEQ ID NO: 286 (FIG. 25));

(16) (a) having reduced binding to human TIM3 in which 1, 2, 3, 4, 5, 6, 7, 8 or 9 of amino acids C58, P59, F61, E62, C63, R111, D120, and optionally D104 and Q113

(numbering per SEQ ID NO: 286 (FIG. 25)) are substituted with another amino acid relative to binding to wildtype human TIM3; (b) binding to $^{49}$VPVCWGK-GACPVFE$^{62}$ (SEQ ID NO: 367), $^{111}$RIQIPGIMNDEKFNLKL$^{127}$ (SEQ ID NO: 368) and $^{119}$NDEKFNLKL$^{127}$ (SEQ ID NO: 373), as determined by HDX-MS, as described in the Examples; and/or (c) competing with or cross-blocking with the binding to human TIM3 of 13A3 or TIM3.18.IgG1.3, e.g., as described in the Examples;
(17) binding to hTIM3-IgV with a $K_D$ of $5\times10^{-8}$ M, $2\times10^{-8}$ M, $10^{-8}$ M or $5\times10^{-9}$ M or less, as determined by the method described in Example 22;
(18) binding to hTIM3-IgV with a $K_D$ of $10^{-7}$ M, $2\times10^{-8}$ M or $10^{-8}$ M or less, as determined by the method described in Example 22;
(19) binding to cynoTIM3-ECD with a $K_D$ of $5\times10^{-7}$ M, $2\times10^{-8}$ M or $10^{-8}$ M or less, as determined by the method described in Example 22; and/or
(20) binding to hTIM3-ECD with a $K_D$ of $8\times10^{-8}$ M, $5\times10^{-8}$ M or $10^{-8}$ M or less, as determined by the method described in Example 22.

In some embodiments, the heavy chain variable region CDR2 sequence comprises an amino acid sequence selected from the group consisting of amino acid sequences of SEQ ID NOs: 46-52, 122-125, 413, and 415, and conservative modifications thereof, e.g., 1, 2, 3, 4, 5, 1-2, 1-3, 1-4 or 1-5 conservative amino acid substitutions; and the light chain variable region CDR2 sequence comprises an amino acid sequence selected from the group consisting of amino acid sequences of SEQ ID NOs: 66-67, and conservative modifications thereof, e.g., 1, 2, 3, 4, 5, 1-2, 1-3, 1-4 or 1-5 conservative amino acid substitutions.

In some embodiments, the heavy chain variable region CDR1 sequence comprises an amino acid sequence selected from the group consisting of amino acid sequences of SEQ ID NOs: 41-45, and conservative modifications thereof, e.g., 1, 2, 3, 4, 5, 1-2, 1-3, 1-4 or 1-5 conservative amino acid substitutions; and the light chain variable region CDR1 sequence comprises an amino acid sequence selected from the group consisting of amino acid sequences of SEQ ID NOs: 64-65, and conservative modifications thereof, e.g., 1, 2, 3, 4, 5, 1-2, 1-3, 1-4 or 1-5 conservative amino acid substitutions.

In some embodiments, the antibody can exhibit one or more, two or more, three or more, four or more, five or more, six or more, seven or more, eight or more, nine or more, or all of the functional properties listed as (1) through (20) above. Such antibodies can be, for example, human antibodies, humanized antibodies or chimeric antibodies.

Conservative amino acid substitutions can also be made in portions of the antibodies other than, or in addition to, the CDRs. For example, conservative amino acid modifications can be made in a framework region or in the Fc region. A variable region or a heavy or light chain can comprise 1, 2, 3, 4, 5, 1-2, 1-3, 1-4, 1-5, 1-10, 1-15, 1-20, 1-25, or 1-50 conservative amino acid substitutions relative to the anti-TIM3 antibody sequences provided herein. In some embodiments, an anti-TIM3 antibody comprises a combination of conservative and non-conservative amino acid modification.

VI. Antibodies Binding to the Same Epitope or Competing for Binding

Also provided are antibodies that compete for binding to human TIM3 with one or more of the particular anti-TIM3 antibodies described herein (e.g., antibodies 13A3, 3G4, 17C3, 17C8, 9F6, 8B9, 8C4, 14H7, 23B3, and/or TIM3.2-TIM3.18, TIM3.20, TIM3.21, TIM3.22, TIM3.23, TIM3.24, and TIM3.25). Such competing antibodies can be identified based on their ability to competitively inhibit binding to human TIM3 of one or more of monoclonal antibodies 13A3, 3G4, 17C3, 17C8, 9F6, 8B9, 8C4, 14H7, 23B3, and/or TIM3.2-TIM3.18, TIM3.20, TIM3.21, TIM3.22, TIM3.23, IM3.24, and TIM3.25 in standard TIM3 binding assays. For example, standard ELISA assays or competitive ELISA assays can be used in which a recombinant human TIM3 protein is immobilized on the plate, various concentrations of unlabeled first antibody is added, the plate is washed, labeled second antibody is added, and the amount of label is measured. If the increasing concentration of the unlabeled (first) antibody (also referred to as the "blocking antibody") inhibits the binding of the labeled (second) antibody, the first antibody is said to inhibit the binding of the second antibody to the target on the plate, or is said to compete with the binding of the second antibody. Additionally or alternatively, Biacore analysis can be used to assess the ability of the antibodies to compete. The ability of a test antibody to inhibit the binding of an anti-TIM3 antibody described herein to TIM3 demonstrates that the test antibody can compete with the antibody for binding to human TIM3.

Accordingly, provided herein are anti-TIM3 antibodies that inhibit the binding of an anti-TIM3 antibodies described herein to TIM3 on cells, e.g., activated T cells, by at least 50%, 55%, 60%, 65%, 70%, 75%, 80%, 85%, 90%, 91%, 92%, 93%, 94%, 95%, 97%, 98%, 99%, or 100% and/or whose binding to human TIM3 on cells, e.g., activated T cells, is inhibited by at least 50%, 55%, 60%, 65%, 70%, 75%, 80%, 85%, 90%, 91%, 92%, 93%, 94%, 95%, 96%, 97%, 98%, 99%, or 100%, e.g., as measured by ELISA or FACS, such as by using the assay described in the following paragraph.

An exemplary competition experiment to determine, e.g., whether a first antibody blocks the binding of (i.e., "competes with") a second antibody, can be conducted as described in the Examples, or as follows: activated human T cells are prepared as follows: Peripheral Blood Mononuclear Cells (PBMCs) are isolated from human whole blood using Ficoll gradient and activated with 10 μg/mL phytohaemagglutinin (PHA-L) (USBiol #P3370-30) and 2001U/mL recombinant IL-2 (Peprotech #200-02) for 3 days. The activated T cells are resuspended in FACS buffer (PBS with 5% Fetal Bovine Serum) and seeded at 10 cells per sample well in a 96 well plate. The plate is set on ice followed by the addition of unconjugated first antibody at concentrations ranging from 0 to 50 μg/mL (three-fold titration starting from a highest concentration of 50 pg/mL). An unrelated IgG can be used as an isotype control for the first antibody and added at the same concentrations (three-fold titration starting from a highest concentration of 50 μg/mL). A sample pre-incubated with 50 μg/mL unlabeled second antibody can be included as a positive control for complete blocking (100% inhibition) and a sample without antibody in the primary incubation can be used as a negative control (no competition; 0% inhibition). After 30 minutes of incubation, labeled, e.g., biotinylated, second antibody is added at a concentration of 2 μg/mL per well without washing. Samples are incubated for another 30 minutes on ice. Unbound antibodies are removed by washing the cells with FACS buffer. Cell-bound labeled second antibody is detected with an agent that detects the label, e.g., PE conjugated streptavidin (Invitrogen, catalog #S21388) for detecting biotin. The samples are acquired on a FACS Calibur Flow Cytometer (BD, San Jose) and analyzed with FLOWJO® software (Tree Star, Inc., Ashland, OR). The results can be represented as the % inhibition (i.e., subtracting from 100% the amount of label at each concentration divided by the amount of label obtained with no blocking antibody). Typically, the same experiment is then conducted in the reverse, i.e., the first antibody is the second antibody and the second antibody is the first antibody.

In some embodiments, an antibody at least partially (e.g., at least 10%, 20%, 30%, 40%, 50%, 60%, 70%, 80%, or 90%) or completely (100%) blocks the binding of the other antibody to the target, e.g., human TIM3 or portion thereof, and regardless of whether inhibition occurs when one or the other antibody is the first antibody. A first and a second antibody "cross-block" binding of each other to the target, when the antibodies compete with each other both ways, i.e., in competition experiments in which the first antibody is added first and in competition experiments in which the second antibody is added first.

In some embodiments, anti-TIM3 antibodies bind to the same epitope as that of the anti-TIM3 antibodies described herein (e.g., 13A3, 3G4, 17C3, 17C8, 9F6, 8B9, 8C4, 14H7, 23B3, and/or TIM3.2-TIM3.18, TIM3.20, TIM3.21, TIM3.22, TIM3.23, TIM3.24, and TIM3.25), e.g., as determined by a given epitope mapping technique. Techniques for determining antibodies that bind to the "same epitope on TIM3" with the anti-TIM3 antibodies described herein include, for example, epitope mapping methods, such as, x-ray analyses of crystals of antigen:antibody complexes which provides atomic resolution of the epitope. Other methods monitor the binding of the antibody to antigen fragments or mutated variations of the antigen where loss of binding due to a modification of an amino acid residue within the antigen sequence is often considered an indication of an epitope component (see FIG. 25). In addition, computational combinatorial methods for epitope mapping can also be used. Methods can also rely on the ability of an antibody of interest to affinity isolate specific short peptides (either in native three dimensional form or in denatured form) from combinatorial phage display peptide libraries. The peptides are then regarded as leads for the definition of the epitope corresponding to the antibody used to screen the peptide library. For epitope mapping, computational algorithms have also been developed which have been shown to map conformational discontinuous epitopes.

Antibodies that compete for binding with, or bind to the same epitope as, the anti-TIM3 antibodies described herein can be identified by using art-known methods. For example, mice can be immunized with human TIM3 as described herein, hybridomas produced, and the resulting monoclonal antibodies screened for the ability to compete with an antibody described herein for binding to human TIM3. Mice can also be immunized with a smaller fragment of TIM3 containing the epitope to which the antibody binds. The epitope or region comprising the epitope can be localized by, e.g., screening for binding to a series of overlapping peptides spanning TIM3. Alternatively, the method of Jespers et al., *Biotechnology* 12:899, 1994 can be used to guide the selection of antibodies having the same epitope and therefore similar properties to an anti-TIM3 antibody described herein. Using phage display, first the heavy chain of the anti-TIM3 antibody is paired with a repertoire of (human) light chains to select a TIM3-binding antibody, and then the new light chain is paired with a repertoire of (human) heavy chains to select a (human) TIM3-binding antibody having the same epitope or epitope region as an anti-TIM3 antibody described herein. Alternatively variants of an antibody described herein can be obtained by mutagenesis of cDNA encoding the heavy and light chains of the antibody.

Alanine scanning mutagenesis, as described by Cunningham and Wells (1989) *Science* 244: 1081-1085, or some other form of point mutagenesis of amino acid residues in TIM3 can also be used to obtain TIM3 antibody binding characteristics.

Binding characteristics of a specific antibody can also be determined by assessing binding of the antibody to peptides comprising fragments of TIM3, e.g., non-denatured or denatured fragments. A series of overlapping peptides encompassing the sequence of TIM3 (e.g., human TIM3) can be synthesized and screened for binding, e.g., in a direct ELISA, a competitive ELISA (where the peptide is assessed for its ability to prevent binding of an antibody to TIM3 bound to a well of a micro titer plate), or on a chip.

Binding characteristics of anti-TIM3 antibodies can also be obtained by MS-based protein footprinting, such as Hydrogen/deuterium exchange mass spectrometry (HDX-MS) and Fast Photochemical Oxidation of Proteins (FPOP). HDX-MS can be conducted, e.g., as described in WO2015/018735 and in Wei et al. (2014) *Drug Discovery Today* 19:95, the methods of which are specifically incorporated by reference herein. FPOP can be conducted as described, e.g., in Hambley and Gross (2005) *J. American Soc. Mass Spectrometry* 16:2057, the methods of which are specifically incorporated by reference herein.

Binding characteristics anti-TIM3 antibodies can also be obtained by structural methods, such as X-ray crystal structure determination (e.g., WO2005/044853), molecular modeling and nuclear magnetic resonance (NMR) spectroscopy, including NMR determination of the H-D exchange rates of labile amide hydrogens in TIM3 when free and when bound in a complex with an antibody of interest (Zinn-Justin et al. (1992) *Biochemistry* 31, 11335-11347; Zinn-Justin et al. (1993) *Biochemistry* 32, 6884-6891).

With regard to X-ray crystallography, crystallization can be accomplished using any of the known methods in the art (e.g., Giege et al. (1994) *Acta Crystallogr. D* 50:339-350; McPherson (1990) *Eur. J. Biochem.* 189: 1-23), including microbatch (e.g., Chayen (1997) *Structure* 5: 1269-1274), hanging-drop vapor diffusion (e.g., McPherson (1976) *J. Biol. Chem.* 251:6300-6303), seeding and dialysis. It is desirable to use a protein preparation having a concentration of at least about 1 mg/mL or about 10 mg/mL to about 20 mg/mL. Crystallization can be best achieved in a precipitant solution containing polyethylene glycol 1000-20,000 (PEG; average molecular weight ranging from about 1000 to about 20,000 Da), about 5000 to about 7000 Da, or about 6000 Da, with concentrations ranging from about 10% to about 30% (w/v). It can also be desirable to include a protein stabilizing agent, e.g., glycerol at a concentration ranging from about 0.5% to about 20%. A suitable salt, such as sodium chloride, lithium chloride or sodium citrate can also be desirable in the precipitant solution, in a concentration ranging from about 1 mM to about 1000 mM. The precipitant is buffered to a pH of from about 3.0 to about 5.0. Specific buffers useful in the precipitant solution can vary and are well-known in the art (Scopes, *Protein Purification: Principles and Practice*, Third ed., (1994) *Springer-Verlag*, New York). Examples of useful buffers include, but are not limited to, HEPES, Tris, MES and acetate. Crystals can be grow at a wide range of temperatures, including 2° C., 4° C., 8° C. and 26° C.

Antibody: antigen crystals can be studied using well-known X-ray diffraction techniques and can be refined using computer software such as X-PLOR (Yale University, 1992, distributed by Molecular Simulations, Inc.; see e.g., Blundell & Johnson (1985) *Meth. Enzymol.* 114 & 115, H. W. Wyckoff et al., eds., Academic Press; U.S. Patent Application Publication No. 2004/0014194), and BUSTER (Bricogne (1993) *Acta Cryst. D* 49:37-60; Bricogne (1997) *Meth. Enzymol.* 276A:361-423, Carter & Sweet, eds.; Roversi et al. (2000) *Acta Cryst. D* 56: 1313-1323), the disclosures of which are hereby incorporated by reference in their entireties.

Anti-TIM3 antibodies can bind to the same epitope as any of the anti-TIM3 antibodies having amino acid sequences described herein, as determined by an epitope mapping technique, such as a technique described herein.

Antibodies binding to human TIM3 and optionally cyno TIM3 with similar binding characteristics as the anti-TIM3 antibodies described herein and determined by one of the methods used in the Examples, are encompassed herein.

In some embodiments, anti-TIM3 antibodies described herein bind to an epitope, e.g., a conformational epitope, in the extracellular portion of human TIM3, e.g., in the Ig like domain or IgV domain of the extracellular region, i.e., amino acids 22 to 130 of SEQ ID NO: 286 (FIG. 25). In some embodiments, an anti-TIM3 antibody binds to an epitope located within amino acids 22 to 120 of human TIM3 extracellular domain (SEQ ID NO: 286) or 1-99 of mature human TIM3 (SEQ ID NO: 290) (see Examples). In some embodiments, an anti-TIM3 antibody binds to, or to an epitope within, a region consisting of amino acids 58-64 of human TIM3 having SEQ ID NO: 286, which corresponds to amino acid residues 37-43 of mature human TIM3 (CPVFECG, SEQ ID NO: 296; see FIG. 25). In some embodiments, an anti-TIM3 antibody binds to, or to an epitope within, a region consisting of amino acids 111-120 of human TIM3 having SEQ ID NO: 286, which corresponds to amino acid residues 90-99 of mature human TIM3 (RIQIPGIMND, SEQ ID NO: 298; see FIG. 25). In some embodiments, an anti-TIM3 antibody binds to, or to an epitope within, a region consisting of amino acids 58-64 of human TIM3 having SEQ ID NO: 286 (CPVFECG, SEQ ID NO: 296) and a region consisting of amino acids 111-120 of human TIM3 having SEQ ID NO: 286 (RIQIPGIMND, SEQ ID NO: 298; see FIG. 25). In some embodiments, an anti-TIM3 antibody binds to, or to an epitope within, a region consisting of amino acids 78-89 of human TIM3 having SEQ ID NO: 286, which corresponds to amino acid residues 57-83 of mature human TIM3 (WTSRYWLNGDFR, SEQ ID NO: 297; see FIG. 25).

In some embodiments, an anti-TIM3 antibody binds to substantially the same epitope as that of 13A3. In some embodiments, an anti-TIM3 antibody binds to an epitope (or region of human TIM3) comprising one or more of amino acid residues C58, P59, F61, E62, C63, R111, and D120 of SEQ ID NO: 286 (FIG. 25). In some embodiments, an anti-TIM3 antibody binds to an epitope (or region of human TIM3) comprising one or more of amino acid residues C58, P59, F61, E62, C63, D104, R111, Q113 and D120 of SEQ ID NO: 286 (FIG. 25). In some embodiments, an anti-TIM3 antibody does not bind significantly, or only with significantly reduced binding affinity, to a human TIM3 protein in which one or more of amino acid residues C58, P59, F61, E62, C63, R111, and D120 of SEQ ID NO: 286 is changed to another amino acid, e.g., in a non-conservative amino acid substitution. In some embodiments, an anti-TIM3 antibody does not bind significantly, or only with significantly reduced binding affinity, to a human TIM3 protein in which one or more of amino acid residues C58, P59, F61, E62, C63, D104, R111, Q113 and D120 of SEQ ID NO: 286 is changed to another amino acid, e.g., in a non-conservative amino acid substitution.

In some embodiments, an anti-TIM3 antibody binds to substantially the same epitope as that of 3G4. In some embodiments, an anti-TIM3 antibody binds to an epitope (or region of human TIM3) comprising one or more of amino acids residues C58, P59, V60, F61, E62, C63, G116, and M118 of SEQ ID NO: 286 (FIG. 25). In some embodiments, an anti-TIM3 antibody binds to an epitope (or region of human TIM3) comprising one or more of amino acid residues C58, P59, V60, F61, E62, C63, D104, G116, and M118 of SEQ ID NO: 286 (FIG. 25). In some embodiments, an anti-TIM3 antibody does not bind significantly, or only with significantly reduced binding affinity, to a human TIM3 protein in which one or more of amino acid residues C58, P59, V60, F61, E62, C63, G116, and M118 of SEQ ID NO: 286 is changed to another amino acid, e.g., in a non-conservative amino acid substitution. In some embodiments, an anti-TIM3 antibody does not bind significantly, or only with significantly reduced binding affinity, to a human TIM3 protein in which one or more of amino acid residues C58, P59, V60, F61, E62, C63, D104, G116, and M118 of SEQ ID NO: 286 is changed to another amino acid, e.g., in a non-conservative amino acid substitution.

In some embodiments, an anti-TIM3 antibody binds to substantially the same epitope as that of 17C3. In some embodiments, an anti-TIM3 antibody binds to an epitope (or region of human TIM3) comprising one or more of amino acids residues C58, P59, V60, F61, E62, C63, G64, and G116 of SEQ ID NO: 286 (FIG. 25). In some embodiments, an anti-TIM3 antibody binds to an epitope (or region of human TIM3) comprising one or more of amino acid residues C58, P59, V60, F61, E62, C63, G64, D104, and G116 of SEQ ID NO: 286 (FIG. 25). In some embodiments, an anti-TIM3 antibody does not bind significantly, or only with significantly reduced binding affinity, to a human TIM3 protein in which one or more of amino acid residues C58, P59, V60, F61, E62, C63, G64, and G116 of SEQ ID NO: 286 is changed to another amino acid, e.g., in a non-conservative amino acid substitution. In some embodiments, an anti-TIM3 antibody does not bind significantly, or only with significantly reduced binding affinity, to a human TIM3 protein in which one or more of amino acid residues C58, P59, V60, F61, E62, C63, G64, D104, and G116 of SEQ ID NO: 286 is changed to another amino acid, e.g., in a non-conservative amino acid substitution.

In some embodiments, an anti-TIM3 antibody binds to substantially the same epitope as that of 8B9. In some embodiments, an anti-TIM3 antibody binds to an epitope (or region of human TIM3) comprising one or more of amino acids residues L48, W78, S80, R81, W83, G86, D87, and R89 of SEQ ID NO: 286 (FIG. 25). In some embodiments, an anti-TIM3 antibody binds to an epitope (or region of human TIM3) comprising one or more of amino acid residues L48, W78, S80, R81, W83, L84, G86, D87, and R89 of SEQ ID NO: 286 (FIG. 25). In some embodiments, an anti-TIM3 antibody binds to substantially the same epitope as that of 8B9. In some embodiments, an anti-TIM3 antibody binds to an epitope (or region of human TIM3) comprising one or more of amino acids residues L48, W78, S80, R81, W83, G86, D87, R89, and D104 of SEQ ID NO: 286 (FIG. 25). In some embodiments, an anti-TIM3 antibody does not bind significantly, or only with significantly reduced binding affinity, to a human TIM3 protein in which one or more of amino acid residues L48, W78, S80, R81, W83, G86, D87, and R89 of SEQ ID NO: 286 is changed to another amino acid, e.g., in a non-conservative amino acid substitution. In some embodiments, an anti-TIM3 antibody does not bind significantly, or only with significantly reduced binding affinity, to a human TIM3 protein in which one or more of amino acid residues L48, W78, S80, R81, W83, L84, G86, D87, and R89 of SEQ ID NO: 286 is changed to another amino acid, e.g., in a non-conservative amino acid substitution. In some embodiments, an anti-TIM3 antibody does not bind significantly, or only with significantly reduced binding affinity, to a human TIM3 protein in which one or more of amino acid residues L48, W78, S80, R81, W83, G86, D87, R89, and D104 of SEQ ID NO: 286 (FIG. 25) is changed to another amino acid, e.g., in a non-conservative amino acid substitution.

In some embodiments, anti-TIM3 antibodies compete for binding to human TIM3 with (or inhibit binding of) anti-TIM3 antibodies comprising CDRs or variable regions described herein, e.g., those of antibodies 13A3, 3G4, 17C3, 17C8, 9F6, 8B9, 8C4, 14H7, 23B3, and any of TIM3.2 to TIM3.18, TIM3.20, TIM3.21, TIM3.22, TIM3.23, TIM3.24, and TIM3.25. In some embodiments, anti-TIM3 antibodies inhibit binding of antibodies 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 to human TIM3 by at least 50%, 60%, 70%, 80%, 90%6 or by 100%. In some embodiments, 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 inhibit binding of anti-TIM3 antibodies to human TIM3 by at least 50%, 60%, 70%, 80%, 90% or by 100%. In some embodiments, anti-TIM3 antibodies inhibit binding of 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 to human TIM3 by at least 50%, 60%, 70%, 80%, 90% or by 100% and 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 inhibit binding of the anti-TIM3 antibodies to human TIM3 by at least 50%, 60%, 70%, 80%, 90% or by 100% (e.g., compete in both directions).

In some embodiments, anti-TIM3 antibodies compete for binding to human TIM3 with anti-TIM3 antibodies comprising CDRs or variable regions of anti-TIM3 antibodies 13A3, 3G4, 17C3, 17C8, 9F6, 14H7, and 23B3 (and variants thereof). In some embodiments, anti-TIM3 antibodies do not compete for binding to human TIM3 with anti-TIM3 antibodies comprising CDRs or variable regions of anti-TIM3 antibodies 8B9 and 8C4 (and variants thereof).

VII. Engineered and Modified Antibodies

Also provided are engineered and modified antibodies that can be prepared using an antibody having one or more of the VH and/or VL sequences disclosed herein as starting material to engineer a modified antibody, which modified antibody can have altered properties from the starting antibody. An antibody can be engineered by modifying one or more residues within one or both variable regions (i.e., VH and/or VL), for example within one or more CDR regions and/or within one or more framework regions. Additionally or alternatively, an antibody can be engineered by modifying residues within the constant region(s), for example to alter the effector function(s) of the antibody.

One type of variable region engineering that can be performed is CDR grafting. Antibodies interact with target antigens predominantly through amino acid residues that are located in the six heavy and light chain complementarity determining regions (CDRs). For this reason, the amino acid sequences within CDRs are more diverse between individual antibodies than sequences outside of CDRs. Because CDR sequences are responsible for most antibody-antigen interactions, it is possible to express recombinant antibodies that mimic the properties of specific naturally-occurring antibodies by constructing expression vectors that include CDR sequences from the specific naturally-occurring antibody grafted onto framework sequences from a different antibody with different properties (see, e.g., Riechmann, L. et al. (1998) *Nature* 332:323-327; Jones, P. et al. (1986) *Nature* 321:522-525; Queen, C. et al. (1989) *Proc. Natl. Acad. Sci. U.S.A.* 86: 10029-10033; U.S. Pat. No. 5,225,539 to Winter, and U.S. Pat. Nos. 5,530,101; 5,585,089; 5,693,762 and 6,180,370 to Queen et al.).

Accordingly, some embodiments described herein pertain to an isolated monoclonal antibody, or antigen binding portion thereof, comprising a heavy chain variable region comprising CDR1, CDR2, and CDR3 sequences comprising an amino acid sequence selected from the group consisting of SEQ ID NOs: 41-45; SEQ ID NOs: 46-52, 122-125, 413, and 415; and SEQ ID NOs: 53-59, 126-129, 414, and 416; respectively, and a light chain variable region comprising CDR1, CDR2, and CDR3 sequences comprising an amino acid sequence selected from the group consisting of SEQ ID NOs: 64-65; SEQ ID NOs: 66-67; and SEQ ID NOs: 68-71, 419; respectively. Thus, such antibodies contain the VH and VL CDR sequences of monoclonal antibodies 13A3, 3G4, 17C3, 17C8, 9F6, 8B9, 8C4, 14H7, 23B3, or any one of TIM3.2 to TIM3.18, TIM3.20, TIM3.21, TIM3.22, TIM3.23, TIM3.24, or TIM3.25, yet can contain different framework sequences from these antibodies.

Such framework sequences can be obtained from public DNA databases or published references that include germline antibody gene sequences. For example, germline DNA sequences for human heavy and light chain variable region genes can be found in the "VBase" human germline sequence database (available on the Internet at mrc-cpe.cam.ac.uk/vbase), as well as in Kabat, E. A., et al. (1991) Sequences of Proteins of Immunological Interest, Fifth Edition, U.S. Department of Health and Human Services, NIH Publication No. 91-3242; Tomlinson, I. M., et al. (1992) "The Repertoire of Human Germline V$_H$ Sequences Reveals about Fifty Groups of V$_H$ Segments with Different Hypervariable Loops" *Mol. Biol.* 227:776-798; and Cox, J. P. L. et al. (1994) "A Directory of Human Germ-line V$_H$ Segments Reveals a Strong Bias in their Usage" *Eur. J. Immunol.* 24:827-836; the contents of each of which are expressly incorporated herein by reference.

In some embodiments, the framework sequences for use in the anti-TIM3 antibodies described herein are those that are structurally similar to the framework sequences used by the anti-TIM3 antibodies described herein. The VH CDR1, 2 and 3 sequences, and the VL CDR1, 2 and 3 sequences, can be grafted onto framework regions that have the identical sequence as that found in the germline immunoglobulin gene from which the framework sequence derive, or the CDR sequences can be grafted onto framework regions that contain one or more mutations as compared to the germline sequences. For example, it has been found that in certain instances it is beneficial to mutate residues within the framework regions to maintain or enhance the antigen binding ability of the antibody (see, e.g., U.S. Pat. Nos. 5,530,101; 5,585,089; 5,693,762; and 6,180,370 to Queen et al.).

Engineered anti-TIM3 antibodies described herein include those in which modifications have been made to framework residues within VH and/or VL, e.g., to improve the properties of the antibody, e.g., a mutation at amino acid 107 in 9F6. Typically such framework modifications are made to decrease the immunogenicity of the antibody. For example, one approach is to "backmutate" one or more framework residues to the corresponding germline sequence. More specifically, an antibody that has undergone somatic mutation can contain framework residues that differ from the germline sequence from which the antibody is derived. Such residues can be identified by comparing the antibody framework sequences to the germline sequences from which the antibody is derived. To return the framework region sequences to their germline configuration, the somatic mutations can be "backmutated" to the germline sequence by, for example, site-directed mutagenesis or PCR-mediated mutagenesis. Such "backmutated" antibodies are also intended to be encompassed. Another type of framework modification involves mutating one or more residues within the framework region, or even within one or more CDR regions, to remove T cell epitopes to thereby reduce the potential immunogenicity of the antibody. This approach is also referred to as "deimmunization" and is described in further detail in U.S. Patent Publication No. 20030153043 by Carr et al.

Another type of variable region modification is to mutate amino acid residues within the VH and/or VL CDR1, CDR2 and/or CDR3 regions to thereby improve one or more binding properties (e.g., affinity) of the antibody of interest. Site-directed mutagenesis or PCR-mediated mutagenesis can be performed to introduce the mutation(s) and the effect on antibody binding, or other functional property of interest, can be evaluated in in vitro or in vivo assays as described herein and provided in the Examples. In some embodiments, conservative modifications (as discussed above) are introduced. The mutations can be amino acid substitutions, additions or deletions. Moreover, typically no more than one, two, three, four or five residues within a CDR region are altered.

Accordingly, also provided are isolated anti-TIM3 monoclonal antibodies, or antigen binding portions thereof, comprising a heavy chain variable region comprising:
  (a) a VH CDR1 region comprising an amino acid sequence selected from the group consisting of SEQ ID NOs: 41-45, or an amino acid sequence having one, two, three, four or five amino acid substitutions, deletions or additions as compared to SEQ ID NOs: 41-45;
  (b) a VH CDR2 region comprising an amino acid sequence selected from the group consisting of SEQ ID NOs: 46-52, 122-125, 413, and 415, or an amino acid sequence having one, two, three, four or five amino acid substitutions, deletions or additions as compared to SEQ ID NOs: 46-52, 122-125, 413, and 415;
  (c) a VH CDR3 region comprising an amino acid sequence selected from the group consisting of SEQ ID NOs: 53-59, 126-129, 414, and 416, or an amino acid sequence having one, two, three, four or five amino acid substitutions, deletions or additions as compared to SEQ ID NOs: 53-59, 126-129, 414, and 416;
  (d) a VL CDR1 region comprising an amino acid sequence selected from the group consisting of SEQ ID NOs: 64-65, or an amino acid sequence having one, two, three, four or five amino acid substitutions, deletions or additions as compared to SEQ ID NOs: 64-65;
  (e) a VL CDR2 region comprising an amino acid sequence selected from the group consisting of SEQ ID NOs: 66-67, or an amino acid sequence having one, two, three, four or five amino acid substitutions, deletions or additions as compared to SEQ ID NOs: 66-67; and
  (f) a VL CDR3 region comprising an amino acid sequence selected from the group consisting of SEQ ID NOs: 68-71, and 419, or an amino acid sequence having one, two, three, four or five amino acid substitutions, deletions or additions as compared to SEQ ID NOs: 68-71, and 419.

Methionine residues in CDRs of antibodies can be oxidized, resulting in potential chemical degradation and consequent reduction in potency of the antibody. Accordingly, also provided are anti-TIM3 antibodies which have one or more methionine residues in the heavy and/or light chain CDRs replaced with amino acid residues which do not undergo oxidative degradation. In some embodiments, the methionine residues in the CDRs of antibodies 13A3, 3G4, 17C3, 17C8, 9F6, 8B9, 8C4, 14H7, 23B3, or any of TIM3.2 to TIM3.18, TIM3.20, TIM3.21, TIM3.22, TIM3.23, TIM3.24, and TIM3.25 are replaced with amino acid residues which do not undergo oxidative degradation.

Similarly, deamidation sites can be removed from anti-TIM3 antibodies, particularly in the CDRs.

Anti-TIM3 variable regions described herein can be linked (e.g., covalently linked or fused) to an Fc, e.g., an IgG1, IgG2, IgG3 or IgG4 Fc, which can be of any allotype or isoallotype, e.g., for IgG1: G1m, G1m1(a), G1m2(x), G1m3(f), G1m17(z); for IgG2: G2m, G2m23(n); for IgG3: G3m, G3m21(g1), G3m28(g5), G3 m11(b0), G3m5(b1), G3m3(b3), G3m14(b4), G3m10(b5), G3m5(s), G3m16(t), G3m6(c3), G3m24(c5), G3m26(u), G3m27(v); and for K: Km, Km1, Km2, Km3 (see, e.g., Jefferies et al. (2009) mAbs 1:1).

In some embodiments, anti-TIM3 variable regions described herein are linked to an effectorless or mostly effectorless Fc, e.g., IgG1.

Generally, variable regions described herein can be linked to an Fc comprising one or more modification, typically to alter one or more functional properties of the antibody, such as serum half-life, complement fixation, Fc receptor binding, and/or antigen-dependent cellular cytotoxicity. Furthermore, an antibody described herein can be chemically modified (e.g., one or more chemical moieties can be attached to the antibody) or be modified to alter its glycosylation, to alter one or more functional properties of the antibody. Each of these embodiments is described in further detail below. The numbering of residues in the Fc region is that of the EU index of Kabat.

The Fc region encompasses domains derived from the constant region of an immunoglobulin, including a fragment, analog, variant, mutant or derivative of the constant region. Suitable immunoglobulins include IgG1, IgG2, IgG3, IgG4, and other classes such as IgA, IgD, IgE and IgM, The constant region of an immunoglobulin is defined as a naturally-occurring or synthetically-produced polypeptide homologous to the immunoglobulin C-terminal region, and can include a CH1 domain, a hinge, a CH2 domain, a CH3 domain, or a CH4 domain, separately or in combination.

Ig molecules interact with multiple classes of cellular receptors. For example IgG molecules interact with three classes of Fcγ receptors (FcγR) specific for the IgG class of antibody, namely FcγRI, FcγRII, and FcγRIII. The important sequences for the binding of IgG to the FcγR receptors have been reported to be located in the CH2 and CH3 domains. The serum half-life of an antibody is influenced by the ability of that antibody to bind to an Fc receptor (FcR).

In some embodiments, the Fc region is a variant Fc region, e.g., an Fc sequence that has been modified (e.g., by amino acid substitution, deletion and/or insertion) relative to a parent Fc sequence (e.g., an unmodified Fc polypeptide that is subsequently modified to generate a variant), to provide desirable structural features and/or biological activity, Generally, variants of the constant region or portions thereof, e.g., CH 1, CL, hinge, CH2 or CH3 domains can comprise 1, 2, 3, 4, 5, 6, 7, 8, 9, 10 or more mutations, and/or at most 10, 9, 8, 7, 6, 5, 4, 3, 2 or 1 mutation, or 1-10 or 1-5 mutations, or comprise an amino acid sequence that is at least about 75%, 80%, 85%, 90%, 95%, 96%, 97%, 98%, or 99% identical to that of the corresponding wild-type region or domain (CH1, CL, hinge, CH2, or CH3 domain, respectively), provided that the heavy chain constant region comprising the specific variant retains the necessary biological activity.

For example, one can make modifications in the Fc region in order to generate an Fc variant that (a) has increased or decreased antibody-dependent cell-mediated cytotoxicity (ADCC), (b) increased or decreased complement mediated cytotoxicity (CDC), (c) has increased or decreased affinity for C1q and/or (d) has increased or decreased affinity for a Fc receptor relative to the parent Fc. Such Fc region variants will generally comprise at least one amino acid modification in the Fc region. Combining amino acid modifications is thought to be particularly desirable. For example, the variant Fc region can include two, three, four, five, etc. substitutions therein, e.g., of the specific Fc region positions identified herein.

A variant Fc region can also comprise a sequence alteration wherein amino acids involved in disulfide bond formation are removed or replaced with other amino acids. Such removal can avoid reaction with other cysteine-containing proteins present in the host cell used to produce the anti-TIM3 antibodies described herein. Even when cysteine residues are removed, single chain Fc domains can still form a dimeric Fc domain that is held together non-covalently. In some embodiments, the Fc region can be modified to make it more compatible with a selected host cell. For example, one can remove the PA sequence near the N-terminus of a typical native Fc region, which can be recognized by a digestive enzyme in *E. coli* such as proline iminopeptidase. In some embodiments, one or more glycosylation sites within the Fc domain can be removed. Residues that are typically glycosylated (e.g., asparagine) can confer cytolytic response. Such residues can be deleted or substituted with unglycosylated residues (e.g., alanine). In some embodiments, sites involved in interaction with complement, such as the C1q binding site, can be removed from the Fc region. For example, one can delete or substitute the EKK sequence of human IgG1. In some embodiments, sites that affect binding to Fc receptors can be removed, preferably sites other than salvage receptor binding sites. In some embodiments, an Fc region can be modified to remove an ADCC site. ADCC sites are known in the art; see, for example, *Molec. Immunol.* 29 (5): 633-9 (1992) with regard to ADCC sites in IgG1. Specific examples of variant Fc domains are disclosed for example, in WO 97/34631 and WO 96/32478.

In some embodiments, the hinge region of Fc is modified such that the number of cysteine residues in the hinge region is altered, e.g., increased or decreased. This approach is described further in U.S. Pat. No. 5,677,425 by Bodmer et al. The number of cysteine residues in the hinge region of Fc is altered to, for example, facilitate assembly of the light and heavy chains or to increase or decrease the stability of the antibody. In some embodiments, the Fc hinge region of an antibody is mutated to decrease the biological half-life of the antibody. More specifically, one or more amino acid mutations are introduced into the CH2-CH3 domain interface region of the Fc-hinge fragment such that the antibody has impaired Staphylococcyl protein A (SpA) binding relative to native Fc-hinge domain SpA binding. This approach is described in further detail in U.S. Pat. No. 6,165,745 by Ward et al.

In some embodiments, the Fc region is altered by replacing at least one amino acid residue with a different amino acid residue to alter the effector function(s) of the antibody. For example, one or more amino acids selected from amino acid residues 234, 235, 236, 237, 297, 318, 320, 322, 330, and/or 331 can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in further detail in U.S. Pat. Nos. 5,624,821 and 5,648,260, both by Winter et al.

In another example, one or more amino acids selected from amino acid residues 329, 331 and 322 can be replaced with a different amino acid residue such that the antibody has altered C1q binding and/or reduced or abolished complement dependent cytotoxicity (CDC). This approach is described in further detail in U.S. Pat. No. 6,194,551 by Idusogie et al.

In another example, one or more amino acid residues within amino acid positions 231 and 239 are altered to thereby alter the ability of the antibody to fix complement. This approach is described further in PCT Publication WO 94/29351 by Bodmer et al.

In yet another example, the Fc region can be modified to decrease antibody dependent cellular cytotoxicity (ADCC) and/or to decrease the affinity for an Fcγ receptor by modifying one or more amino acids at the following positions: 234, 235, 236, 238, 239, 240, 241, 243, 244, 245, 247, 248, 249, 252, 254, 255, 256, 258, 262, 263, 264, 265, 267, 268, 269, 270, 272, 276, 278, 280, 283, 285, 286, 289, 290, 292, 293, 294, 295, 296, 298, 299, 301, 303, 305, 307, 309, 312, 313, 315, 320, 322, 324, 325, 326, 327, 329, 330, 331, 332, 333, 334, 335, 337, 338, 340, 360, 373, 376, 378, 382, 388, 389, 398, 414, 416, 419, 430, 433, 434, 435, 436, 437, 438 or 439. Exemplary substitutions include 236A, 239D, 239E, 268D, 267E, 268E, 268F, 324T, 332D, and 332E. Exemplary variants include 239D/332E, 236A/332E, 236A/239D/332E, 268F/324T, 267E/268F, 267E/324T, and 267E/268F7324T. Other modifications for enhancing FcγR and complement interactions include but are not limited to substitutions 298 A, 333A, 334A, 326A, 247I, 339D, 339Q, 280H, 290S, 298D, 298V, 243L, 292P, 300L, 396L, 305I, and 396L. These and other modifications are reviewed in Strohl, 2009, *Current Opinion in Biotechnology* 20:685-691.

Fc modifications that increase binding to an Fcγ receptor include amino acid modifications at any one or more of amino acid positions 238, 239, 248, 249, 252, 254, 255, 256, 258, 265, 267, 268, 269, 270, 272, 279, 280, 283, 285, 298, 289, 290, 292, 293, 294, 295, 296, 298, 301, 303, 305, 307, 312, 315, 324, 327, 329, 330, 335, 337, 338, 340, 360, 373, 376, 379, 382, 388, 389, 398, 414, 416, 419, 430, 434, 435, 437, 438 or 439 of the Fc region, wherein the numbering of the residues in the Fc region is that of the EU index as in abat (WO00/42072).

Other Fc modifications that can be made to Fcs are those for reducing or ablating binding to FcγR and/or complement proteins, thereby reducing or ablating Fc-mediated effector functions such as ADCC, ADCP, and CDC. Exemplary modifications include but are not limited substitutions, insertions, and deletions at positions 234, 235, 236, 237, 267, 269, 325, 328, 330, and/or 331 (e.g., 330 and 331), wherein numbering is according to the EU index. Exemplary substitutions include but are not limited to 234A, 235E, 236R, 237A, 267R, 269R, 325L, 328R, 330S, and 331S (e.g., 330S, and 331S), wherein numbering is according to the EU index. An Fc variant can comprise 236R/328R. Other modifications for reducing FcγR and complement interactions include substitutions 297A, 234A, 235A, 237A, 318A, 228P, 236E, 268Q, 309L, 330S, 331 S, 220S, 226S, 229S, 238S, 233P, and 234V, as well as removal of the glycosylation at position 297 by mutational or enzymatic means or by production in organisms such as bacteria that do not glycosylate proteins. These and other modifications are reviewed in Strohl, 2009, *Current Opinion in Biotechnology* 20:685-691.

Optionally, the Fc region can comprise a non-naturally-occurring amino acid residue at additional and/or alternative positions known to one skilled in the art (see, e.g., U.S. Pat. Nos. 5,624,821; 6,277,375; 6,737,056; 6,194,551; 7,317,091; 8,101,720; PCX Patent Publications WO 00/42072; WO 01/58957; WO 02/06919; WO 04/016750; WO 04/029207; WO 04/035752; WO 04/074455; WO 04/099249; WO 04/63351; WO 05/70963; WO 05/040217, WO 05/092925 and WO 06/0201 14).

Fc variants that enhance affinity for an inhibitory receptor FcγRIIb can also be used. Such variants can provide an Fc fusion protein with immunomodulatory activities related to FcγRIIb cells, including for example B cells and monocytes. In some embodiments, the Fc variants provide selectively enhanced affinity to FcγRIIb relative to one or more activating receptors. Modifications for altering binding to FcγRIIb include one or more modifications at a position selected from the group consisting of 234, 235, 236, 237, 239, 266, 267, 268, 325, 326, 327, 328, 330, 331, and 332, according to the EU index. Exemplary substitutions for enhancing FcγRIIb affinity include but are not limited to 234A, 234D, 234E, 234F, 234W, 235D, 235E, 235F, 235R, 235Y, 236D, 236N, 237A, 237D, 237N, 239D, 239E, 266M, 267D, 267E, 268D, 268E, 327D, 327E, 328F, 328W, 328Y, 330S, 331S, and 332E. Exemplary substitutions include 235Y, 236D, 239D, 266M, 267E, 268D, 268E, 328F, 328W, and 328Y. Other Fc variants for enhancing binding to FcγRIIb include 235Y/267E, 236D/267E, 239D/268D, 239D/267E, 267E/268D, 267E/268E, and 267E/328F.

The affinities and binding properties of an Fc region for its ligand can be determined by a variety of in vitro assay methods (biochemical or immunological based assays) known in the art including but not limited to, equilibrium methods (e.g., enzyme-linked immunosorbent assay (ELISA), or radioimmunoassay (RIA)), or kinetics (e.g., BIACORE analysis), and other methods such as indirect binding assays, competitive inhibition assays, fluorescence resonance energy transfer (FRET), gel electrophoresis and chromatography (e.g., gel filtration). These and other methods can utilize a label on one or more of the components being examined and/or employ a variety of detection methods including but not limited to chromogenic, fluorescent, luminescent, or isotopic labels. A detailed description of binding affinities and kinetics can be found in Paul, W. E., ed., Fundamental immunology, 4th Ed., Lippincott-Raven, Philadelphia (1999), which focuses on antibody-immunogen interactions.

In some embodiments, the antibody is modified to increase its biological half-life. Various approaches are possible. For example, this can be done by increasing the binding affinity of the Fc region for FcRn, For example, one or more of more of following residues can be mutated: 252, 254, 256, 433, 435, 436, as described in U.S. Pat. No. 6,277,375. Specific exemplary substitutions include one or more of the following: T252L, T254S, and/or T256F. Alternatively, to increase the biological half-life, the antibody can be altered within the CH1 or CL region to contain a salvage receptor binding epitope taken from two loops of a CH2 domain of an Fc region of an IgG, as described in U.S. Pat. Nos. 5,869,046 and 6,121,022 by Presta et al. Other exemplary variants that increase binding to FcRn and/or improve pharmacokinetic properties include substitutions at positions 259, 308, 428, and 434, including for example 259I, 308F, 428L, 428M, 434S, 434I 1. 434F, 434Y, and 434X1. Other variants that increase Fc binding to FcRn include: 250E, 250Q, 428 L, 428F, 250Q/428L (Hinton et al. 2004, *J. Biol. Chem.* 279(8): 6213-6216, Hinton et al. 2006 *Journal of Immunology* 176:346-356), 256A, 272A, 286A, 305A, 307A, 307Q, 31 1A, 312A, 376A, 378Q, 380A, 382A, 434A (Shields et al., *Journal of Biological Chemistry*, 2001, 276(9):6591-6604), 252F, 252T, 252Y, 252W, 254T, 256S, 256R, 256Q, 256E, 256D, 256T, 309P, 31 1 S, 433R, 433S, 434I, 433P, 433Q, 434H, 434F, 434Y, 252Y/254T/256E, 433K/434F/436H, 308T/309P/311S (Dall Acqua et al. *Journal of Immunology*, 2002, 169:5171-5180, Dall'Acqua et al., 2006, *Journal of Biological Chemistry* 281:23514-23524). Other modifications for modulating FcRn binding are described in Yeung et al., 2010, *J Immunol*, 182:7663-7671.

In some embodiments, hybrid IgG isotypes with particular biological characteristics can be used. For example, an IgG1/IgG3 hybrid variant can be constructed by substituting IgG1 positions in the CH2 and/or CH3 region with the amino acids from IgG3 at positions where the two isotypes differ. Thus a hybrid variant IgG antibody can be constructed that comprises one or more substitutions, e.g., 274Q, 276K, 300F, 339T, 356E, 358M, 384S, 392N, 397M, 422I, 435R, and 436F. In some embodiments described herein, an IgG1/IgG2 hybrid variant can be constructed by substituting IgG2 positions in the CH2 and/or CH3 region with amino acids from IgG1 at positions where the two isotypes differ. Thus a hybrid variant IgG antibody can be constructed that comprises one or more substitutions, e.g., one or more of the following amino acid substitutions: 233E, 234L, 235L, −236G (referring to an insertion of a glycine at position 236), and 327A.

Moreover, the binding sites on human IgG1 for FcγRI, FcγRII, FcγRIII and FcRn have been mapped and variants with improved binding have been described (see Shields, R. L. et al. (2001) *J. Biol. Chem.* 276:6591-6604). Specific mutations at positions 256, 290, 298, 333, 334 and 339 were shown to improve binding to FcγRIII. Additionally, the following combination mutants were shown to improve FcγRIII binding: T256A/S298A, S298A/E333A, S298A/K224A and S298A/E333A/K334A, which has been shown to exhibit enhanced FcγRIIIa binding and ADCC activity (Shields et al., 2001). Other IgG1 variants with strongly enhanced binding to FcγRIIIa have been identified, including variants with S239D/I332E and S239D/I332E/A330L mutations which showed the greatest increase in affinity for FcγRIIIa, a decrease in FcγRIIb binding, and strong cytotoxic activity in cynomolgus monkeys (Lazar et al., 2006). Introduction of the triple mutations into antibodies such as alemtuzumab (CD52-specific), trastuzumab (HER2/neu-specific), rituximab (CD20-specific), and cetuximab (EGFR-specific) translated into greatly enhanced ADCC activity in vitro, and the S239D/I332E variant showed an enhanced capacity to deplete B cells in monkeys (Lazar et al., 2006). In addition, IgG1 mutants containing L235V, F243L, R292P, Y300L and P396L mutations which exhibited enhanced binding to FcγRIIIa and concomitantly enhanced ADCC activity in transgenic mice expressing human FcγRIIIa in models of B cell malignancies and breast cancer have been identified (Stavenhagen et al., 2007; Nordstrom et al., 2011). Other Fc mutants that can be used include: S298A/E333A/L334A, S239D/I332E, S239D/I332E/A330L, L235V/F243L/R292P/Y300L/P396L, and M428L/N434S.

In some embodiments, an Fc is chosen that has reduced binding to FcγRs. An exemplary Fc, e.g., IgG1 Fc, with reduced FcγR binding comprises the following three amino acid substitutions: L234A, L235E and G237A.

In some embodiments, an Fc is chosen that has reduced complement fixation. An exemplary Fc, e.g., IgG1 Fc, with reduced complement fixation has the following two amino acid substitutions: A330S and P331S.

In some embodiments, an Fc is chosen that has essentially no effector function, i.e., it has reduced binding to FcγRs and reduced complement fixation. An exemplary Fc, e.g., IgG1 Fc, that is effectorless comprises the following five mutations: L234A, L235E, G237A, A330S and P331S.

When using an IgG4 constant domain, it can include the substitution S228P, which mimics the hinge sequence in IgG1 and thereby stabilizes IgG4 molecules.

In some embodiments, the glycosylation of an antibody is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation can increase the affinity of the antibody for antigen. Such an approach is described in further detail in U.S. Pat. Nos. 5,714,350 and 6,350,861 by Co et al.

Glycosylation of the constant region on N297 can be prevented by mutating the N297 residue to another residue, e.g., N297A, and/or by mutating an adjacent amino acid, e.g., 298 to thereby reduce glycosylation on N297.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant anti-TIM3 antibodies described herein to thereby produce an antibody with altered glycosylation. For example, EP 1,176,195 by Hanai et al. describes a cell line with a functionally disrupted FUT8 gene, which encodes a fucosyl transferase, such that antibodies expressed in such a cell line exhibit hypofucosylation. PCT Publication WO 03/035835 by Presta describes a variant CHO cell line, Led 3 cells, with reduced ability to attach fucose to Asn(297)-linked carbohydrates, also resulting in hypofucosylation of antibodies expressed in that host cell (see also Shields, R. L. et al. (2002) *J. Biol. Chem.* 277:26733-26740). PCT Publication WO 99/54342 by Umana et al. describes cell lines engineered to express glycoprotein-modifying glycosyl transferases (e.g., beta(1,4)-N-acetylglucosaminyltransferase III (GnTIII)) such that antibodies expressed in the engineered cell lines exhibit increased bisecting GlcNac structures which results in increased ADCC activity of the antibodies (see also Umana et al. (1999) *Nat. Biotech.* 17: 176-180).

Another modification of the anti-TIM3 antibodies described herein is pegylation. An antibody can be pegylated to, for example, increase the biological (e.g., serum) half-life of the antibody. To pegylate an antibody, the antibody, or fragment thereof, typically is reacted with polyethylene glycol (PEG), such as a reactive ester or aldehyde derivative of PEG, under conditions in which one or more PEG groups become attached to the antibody or antibody fragment. In some embodiments, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (CI-CIO) alkoxy- or aryloxy-polyethylene glycol or polyethylene glycol-maleimide. In some embodiments, the antibody to be pegylated is an aglycosylated antibody. Methods for pegylating proteins are known in the art and can be applied to the anti-TIM3 antibodies described herein. See, for example, EP 0 154 316 by Nishimura et al. and EP 0 401 384 by Ishikawa et al.

In some embodiments, an anti-TIM3 antibody comprises a heavy chain constant region and a light chain constant region, wherein the heavy chain constant region is selected from the group consisting of SEQ ID NOs: 130-133.

VIII. Antibody Physical Properties

Anti-TIM3 antibodies, e.g., those described herein, have some or all of the physical characteristics of the specific anti-TIM3 antibodies described herein, such as the characteristics described in the Examples.

Anti-TIM3 antibodies described herein can contain one or more glycosylation sites in either the light or heavy chain variable region. Such glycosylation sites can result in increased immunogenicity of the antibody or an alteration of the pK of the antibody due to altered antigen binding (Marshall et al., (1972) *Annu Rev Biochem* 41:673-702; Gala and Morrison (2004) *J. Immunol* 172:5489-94; Wallick et al., (1988) *J Exp Med* 168: 1099-109; Spiro (2002) *Glycobiology* 12:43R-56R; Parekh et al., (1985) *Nature* 316:452-7; Mimura et al., (2000) *Mol Immunol* 37:697-706). Glycosylation has been known to occur at motifs containing an N-X-S/T sequence. In some instances, an anti-TIM3 antibody does not contain variable region glycosylation. This can be achieved either by selecting antibodies that do not contain the glycosylation motif in the variable region or by mutating residues within the glycosylation region.

In some embodiments, the anti-TIM3 antibodies described herein do not contain asparagine isomerism sites. The deamidation of asparagine can occur on N-G or D-G sequences and result in the creation of an isoaspartic acid residue that introduces a kink into the polypeptide chain and decreases its stability (isoaspartic acid effect).

Each antibody will have a unique isoelectric point (pi), which generally falls in the pH range between 6 and 9.5. The pi for an IgG1 antibody typically falls within the pH range of 7-9.5 and the pi for an IgG4 antibody typically falls within the pH range of 6-8. There is speculation that antibodies with a pi outside the normal range can have some unfolding and instability under in vivo conditions. Thus, an anti-TIM3 antibody can contain a pi value that falls in the normal range. This can be achieved either by selecting antibodies with a pi in the normal range or by mutating charged surface residues.

Each antibody will have a characteristic melting temperature, with a higher melting temperature indicating greater overall stability in vivo (Krishnamurthy R and Manning M C (2002) *Curr Pharm Biotechnol* 3:361-71). Generally, the $T_M i$ (the temperature of initial unfolding) can be greater than 60° C., greater than 65° C., or greater than 70° C. The melting point of an antibody can be measured using differential scanning calorimetry (Chen et al., (2003) *Pharm Res* 20: 1952-60; Ghirlando et al., (1999) *Immunol Lett* 68:47-52) or circular dichroism (Murray et al., (2002) *J. Chromatogr Sci* 40:343-9).

In some embodiments, antibodies are selected that do not degrade rapidly. Degradation of an antibody can be measured using capillary electrophoresis (CE) and MALDI-MS (Alexander A J and Hughes D E (1995) *Anal Chem* 67:3626-32).

In some embodiments, antibodies are selected that have minimal aggregation effects, which can lead to the triggering of an unwanted immune response and/or altered or unfavorable pharmacokinetic properties. Generally, antibodies are acceptable with aggregation of 25% or less, 20% or less, 15% or less, 10% or less, or 5% or less. Aggregation can be measured by several techniques, including size-exclusion column (SEC), high performance liquid chromatography (HPLC), and light scattering.

In some embodiments, an anti-TIM3 antibody has a combination of structures and properties described in sections (I), (II), (III), (IV), (V), (VI), (VII), (VIII), and (IX). In some embodiments, an anti-TIM3 antibody cross-competes with Antibodies 13A3, 17C3, 8B9, 8C4, 3G4, 17C8, 9F6, 14H7, 23B3, and/or TIM3.2-TIM3.18, TIM3.20, TIM3.21, TIM3.22, TIM3.23, TIM3.24, and TIM3.25, as described in Sections I and/or VI, derived from the germline sequence as described in Section III, has conserved mutations as described in Section V, and/or has homology to the anti-TIM3 antibodies in Section I and II as described in Section IV in combination with one or more functional properties described anywhere herein.

IX. Methods of Engineering Antibodies

As discussed above, the anti-TIM3 antibodies having VH and VL sequences disclosed herein can be used to create new anti-TIM3 antibodies by modifying the VH and/or VL sequences, or the constant region(s) attached thereto. Thus, in another aspect described herein, the structural features of an anti-TIM3 antibody described herein are used to create structurally related anti-TIM3 antibodies that retain at least one functional property of the anti-TIM3 antibodies described herein, such as binding to human TIM3 and cynomolgus TIM3. For example, one or more CDR regions of 17C3, 8B9, 8C4, 3G4, 17C8, 9F6, 13A3, 14H7, 23B3, or any of TIM3.2 to TIM3.18, TIM3.20, TIM3.21, TIM3.22, TIM3.23, TIM3.24, and TIM3.25 can be combined recombinantly with known framework regions and/or other CDRs to create additional, recombinantly-engineered, anti-TIM3 antibodies described herein, as discussed above. Other types of modifications include those described in the previous section. The starting material for the engineering method is one or more of the VH and/or VL sequences provided herein, or one or more CDR regions thereof. To create the engineered antibody, it is not necessary to actually prepare (i.e., express as a protein) an antibody having one or more of the VH and/or VL sequences provided herein, or one or more CDR regions thereof. Rather, the information contained in the sequence(s) is used as the starting material to create a "second generation" sequence(s) derived from the original sequence(s) and then the "second generation" sequence(s) is prepared and expressed as a protein.

Accordingly, provided herein are methods for preparing an anti-TIM3 antibody comprising:

(a) providing: (i) a heavy chain variable region antibody sequence comprising a CDR1 sequence selected from the group consisting of SEQ ID NOs: 41 to 45, a CDR2 sequence selected from the group consisting of SEQ ID NOs: 46 to 52, 122-125, 413, and 415, and/or a CDR3 sequence selected from the group consisting of SEQ ID NOs: 53 to 59, 126-129, 414, and 416; and (ii) a light chain variable region antibody sequence comprising a CDR1 sequence selected from the group consisting of SEQ ID NOs: 64 and 65, a CDR2 sequence selected from the group consisting of SEQ ID NOs: 66 and 67, and/or a CDR3 sequence selected from the group consisting of SEQ ID NOs: 68 to 71, and 419;

(b) altering at least one amino acid residue within the heavy chain variable region antibody sequence and/or the light chain variable region antibody sequence to create at least one altered antibody sequence; and (c) expressing the altered antibody sequence as a protein.

Standard molecular biology techniques can be used to prepare and express the altered antibody sequence. In some embodiments, the antibody encoded by the altered antibody sequence(s) is one that retains one, some or all of the functional properties of the anti-TIM3 antibodies described herein, which include:

(1) binding to soluble human TIM3, e.g., with a KD of 10 nM or less (e.g., 0.01 nM to 10 nM), e.g., as measured by Biacore, e.g., as described in the Examples;

(2) binding to soluble cynomolgus TIM3, e.g., with a KD of 100 nM or less (e.g., 0.01 nM to 100 nM), e.g., as measured by Biacore, e.g., as described in the Examples;

(3) binding to membrane bound human TIM3, e.g., with an EC50 of 1 ug/mL or less (e.g., 0.01 ug/mL to 1 ug/mL), e.g., as measured by flow cytometry (e.g., as described in the Examples);

(4) binding to membrane bound human TIM3, e.g., with a $K_D$ of 1 nM or less (e.g., 0.01 nM to 10 nM), e.g., as measured by Scatchard analysis, e.g., as described in the Examples;

(5) binding to membrane bound cynomolgus TIM3, e.g., with an EC50 of 20 ug/mL or less (e.g., 0.01 ug/mL to 20 ug/mL), e.g., as measured by flow cytometry (e.g., as described in the Examples);

(6) binding to membrane bound cynomolgus TIM3, e.g., with a KD of 1 nM or less (e.g., 0.01 nM to 10 nM), e.g., as measured by Scatchard analysis, e.g., as described in the Examples;

(7) inducing or enhancing T cell activation (e.g., by blocking or reducing the inhibitory effect of TIM3), as evidenced by (i) increased IFN-γ production in TIM3-expressing T cells (e.g., Th1 cells or TILs) and/or (ii) enhanced proliferation of TIM3-expressing T cells (e.g., Th1 cells or TILs), e.g., as described in the Examples;

(8) stimulating T cell proliferation in a mixed lymphocyte reaction (MLR) assay, e.g., as described in the Examples;

(9) inhibiting the binding of phosphatidylserine to TIM3, e.g., as measured by PS-hTIM3 "in-tandem" blocking assay, e.g., as described in the Examples;

(10) not internalizing or downregulating cell surface TIM3 when binding to TIM3 on cells;

(11) binding to one of the following regions of human TIM3 extracellular domain (SEQ ID NO: 290): (a) CPVFECG (SEQ ID NO: 296); (b) RIQIPGIMND (SEQ ID NO: 298); (c) CPVFECG and RIQIPGIMND (SEQ ID NOs: 296 and 298, respectively); and (d) WTSRYWLNGDFR (SEQ ID NO: 297), e.g., as described in the Examples;

(12) having reduced binding to human TIM3 in which one or more of amino acids L48, C58, P59, V60, F61, E62, C63, G64, W78, S80, R81, W83, L84, G86, D87, R89, D104, R111, Q113, G116, M118, and D120 (as numbered in SEQ ID NO: 286 (FIG. 25)) is substituted with another amino acid relative to binding to wildtype human TIM3, e.g., as described in the Examples;

(13) competing in either direction or both directions for binding to human TIM3 with an antibody comprising VH and VL domains of any one of 13A3, 3G4, 17C3, 17C8, 9F6, 8B9, 8C4, 14H7, 23B3, or TIM3.7, TIM3.8, TIM3.10, TIM3.11, TIM3.12, TIM3.13, TIM3.14, TIM3.15, TIM3.16, TIM3.17, TIM3.18, TIM3.20, TIM3.21, TIM3.22, TIM3.23, and TIM3.25, e.g., as described in the Examples;

(14) binding to human TIM3 regions $^{49}$VPVCWGK-GACPVFE$^{62}$ (SEQ ID NO: 367) and $^{111}$RIQIPGIMNDEKFNLKL$^{127}$ (SEQ ID NO: 368) as determined by HDX-MS, e.g., as described in the Examples;

(15) having the heavy chain and/or light chain variable regions interact with at least 5, 10, 15, 20 or all of the following amino acids of human TIM3: P50, V51, C52, P59, V60, F61, E62, C63, G64, N65, V66, V67, L68, R69, D71, E72, D74, R111, Q113, G116, I117, M118, D120, and optionally T70 and/or I112, as determined by X-ray crystallography (e.g., described in the Examples; numbering per SEQ ID NO: 286 (FIG. 25));

(16) (a) having reduced binding to human TIM3 in which 1, 2, 3, 4, 5, 6, 7, 8 or 9 of amino acids C58, P59, F61, E62, C63, R111, D120, and optionally D104 and Q113 (numbering per SEQ ID NO: 286 (FIG. 25)) are substituted with another amino acid relative to binding to wildtype human TIM3; (b) binding to $^{49}$VPVCWGK-GACPVFE$^{62}$ (SEQ ID NO: 367), $^{1}$"RIQIPGIMNDEKFNLKL$^{1}$" (SEQ ID NO: 368) and $^{119}$NDEKFNLKL$^{127}$ (SEQ ID NO: 373), as determined by HDX-MS, as described in the Examples; and/or (c) competing with or cross-blocking with the binding of 13A3 or TIM3.18.IgG1.3, e.g., as described in the Examples;

(17) binding to hTIM3-IgV with a $K_D$ of $5\times10^{-8}$ M, $2\times10^{-8}$ M, $10^{-8}$ M or $5\times10^{-9}$ M or less, as determined by the method described in Example 22;

(18) binding to hTIM3-IgV with a $K_D$ of $10^{-7}$ M, $2\times10^{-8}$ M or $10^{-8}$ M or less, as determined by the method described in Example 22;

(19) binding to cynoTIM3-ECD with a $K_D$ of $5\times10^{-7}$ M, $2\times10^{-8}$ M or $10^{-8}$ M or less, as determined by the method described in Example 22; and/or

(20) binding to hTIM3-ECD with a $K_D$ of $8\times10^{-8}$ M, $5\times10^{-8}$ M or $10^{-8}$ M or less, as determined by the method described in Example 22.

The altered antibody can exhibit one or more, two or more, three or more, four or more, five or more, six or more, seven or more, eight or more, nine or more, or all of the functional properties set forth as (1) through (16) above. The functional properties of the altered antibodies can be assessed using standard assays available in the art and/or described herein, such as those set forth in the Examples (e.g., ELISAs, FACS).

In some embodiments of the methods of engineering the anti-TIM3 antibodies described herein, mutations can be introduced randomly or selectively along all or part of an anti-TIM3 antibody coding sequence and the resulting modified anti-TIM3 antibodies can be screened for binding activity and/or other functional properties as described herein. Mutational methods have been described in the art. For example, PCT Publication WO 02/092780 by Short describes methods for creating and screening antibody mutations using saturation mutagenesis, synthetic ligation assembly, or a combination thereof. Alternatively, PCT Publication WO 03/074679 by Lazar et al. describes methods of using computational screening methods to optimize physiochemical properties of antibodies.

X. Nucleic Acid Molecules

Another aspect described herein pertains to nucleic acid molecules that encode the anti-TIM3 antibodies described herein. The nucleic acids can be present in whole cells, in a cell lysate, or in a partially purified or substantially pure form. A nucleic acid is "isolated" or "rendered substantially pure" when purified away from other cellular components or other contaminants, e.g., other cellular nucleic acids (e.g., other chromosomal DNA, e.g., the chromosomal DNA that is linked to the isolated DNA in nature) or proteins, by standard techniques, including alkaline/SDS treatment, CsCl banding, column chromatography, restriction enzymes, agarose gel electrophoresis and others well known in the art. See, F. Ausubel, et al., ed. (1987) Current Protocols in Molecular Biology, Greene Publishing and Wiley Interscience, New York. A nucleic acid described herein can be, for example, DNA or RNA and can or cannot contain intronic sequences. In some embodiments, the nucleic acid is a cDNA molecule.

Nucleic acids described herein can be obtained using standard molecular biology techniques. For antibodies expressed by hybridomas (e.g., hybridomas prepared from transgenic mice carrying human immunoglobulin genes as described further below), cDNAs encoding the light and heavy chains of the antibody made by the hybridoma can be obtained by standard PCR amplification or cDNA cloning techniques. For antibodies obtained from an immunoglobulin gene library (e.g., using phage display techniques), nucleic acid encoding the antibody can be recovered from the library.

Some nucleic acids molecules described herein are those encoding the VH and VL sequences of the 13A3, 8B9, 8C4, 17C3, 9F6, 3G4, 17C8, 14H7, 23B3, or any of TIM3.2 to TIM3.18, TIM3.20, TIM3.21, TIM3.22, TIM3.23, TIM3.24, and TIM3.25 antibodies. Exemplary DNA sequences encoding the VH sequences of 13A3, 8B9, 8C4, 17C3, 9F6, 3G4, 17C8, 14H7, and 23B3 are set forth in SEQ ID NOs: 167 to 173, 245 to 254, 359, and 420 to 422. Exemplary DNA sequences encoding the VL sequences of 13A3, 17C3, and 3G4 are set forth in SEQ ID NO: 193. Exemplary DNA sequences encoding the VL sequences of 8B9, 8C4, and 17C8 are set forth in SEQ ID NO: 194. Exemplary DNA sequences encoding the VL sequences of 9F6 are set forth in SEQ ID NOs: 194 to 196. Exemplary DNA sequence encoding the VL sequence of 14H7 is set forth in SEQ ID NO: 427. Exemplary DNA sequences encoding the VL sequences of 23B3 are set forth in SEQ ID NOs: 193 and 428. Exemplary DNA sequences encoding the heavy chain sequences of 13A3, 8B9, 8C4, 17C3, 9F6, 3G4, 17C8, 14H7, and 23B3 are set forth in SEQ ID NOs: 134 to 161, 205 to 244, 355 to 358, and 430 to 441. Exemplary DNA sequences encoding the light chain sequences of 13A3, 8B9, 8C4, 17C3, 9F6, 3G4, 17C8, 14H7, and 23B3 are set forth in SEQ ID NOs: 162 to 166 and 442.

Exemplary nucleic acids encoding the mature VH and VL domains of 13A3.IgG1.1 and 13A3.IgG1.3 (same variable region) antibodies are set forth as SEQ ID NOs: 167 and 193, respectively. Exemplary nucleic acids encoding the mature heavy chains of 13A3.IgG1.1 and 13A3.IgG1.3 antibodies are set forth as SEQ ID NOs: 134 and 148, respectively, and an exemplary nucleic acid encoding the mature light chain of 13A3.IgG1.1 and 13A3.IgG1.3 antibodies is set forth as SEQ ID NO: 162.

Exemplary nucleic acids encoding the mature VH and VL domains of 8B9.IgG1.1 and 8B9.IgG1.3 (same variable region) antibodies are set forth as SEQ ID NOs: 168 and 194, respectively. Exemplary nucleic acids encoding the mature heavy chains of 8B9.IgG1.1 and 8B9.IgG1.3 antibodies are set forth as SEQ ID NOs: 135 and 149, respectively, and an exemplary nucleic acid encoding the mature light chain of 8B9.IgG1.1 and 8B9.IgG1.3 antibodies is set forth as SEQ ID NO: 163.

Exemplary nucleic acids encoding the mature VH and VL domains of 8C4.IgG1.1 and 8C4.IgG1.3 (same variable region) antibodies are set forth as SEQ ID NOs: 169 and 194, respectively. Exemplary nucleic acids encoding the mature heavy chains of 8C4.IgG1.1 and 8C4.IgG1.3 antibodies are set forth as SEQ ID NOs: 136 and 150, respectively, and an exemplary nucleic acid encoding the mature light chain of 8C4.IgG1.1 and 8C4.IgG1.3 antibodies is set forth as SEQ ID NO: 163.

Exemplary nucleic acids encoding the mature VH and VL domains of 17C3.IgG1.1 and 17C3.IgG1.3 (same variable region) antibodies are set forth as SEQ ID NOs: 170 and 193, respectively. Exemplary nucleic acids encoding the mature heavy chains of 17C3.IgG1.1 and 17C3.IgG1.3 antibodies are set forth as SEQ ID NOs: 137 and 151, respectively, and an exemplary nucleic acid encoding the mature light chain of 17C3.IgG1.1 and 17C3.IgG1.3 antibodies is set forth as SEQ ID NO: 162.

Exemplary nucleic acids encoding the mature VH and VL domains of 9F6.IgG1.1 and 9F6.IgG1.3 (same variable region) antibodies are set forth as SEQ ID NOs: 171 and 197, respectively. Exemplary nucleic acids encoding the mature heavy chains of 9F6.IgG1.1 and 9F6.IgG1.3 antibodies are set forth as SEQ ID NOs: 138 and 152, respectively, and an exemplary nucleic acid encoding the mature light chain of 9F6.IgG1.1 and 9F6.IgG1.3 antibodies is set forth as SEQ ID NO: 166.

Exemplary nucleic acids encoding the mature VH and VL domains of 3G4.IgG1.1 and 3G4.IgG1.3 (same variable region) antibodies are set forth as SEQ ID NOs: 172 and 193, respectively. Exemplary nucleic acids encoding the mature heavy chains of 3G4.IgG1.1 and 3G4.IgG1.3 antibodies are set forth as SEQ ID NOs: 139 and 153, respectively, and an exemplary nucleic acid encoding the mature light chain of 3G4.IgG1.1 and 3G4.IgG1.3 antibodies is set forth as SEQ ID NO: 162.

Exemplary nucleic acids encoding the mature VH and VL domains of 17C8.IgG1.1 and 17C8.IgG1.3 (same variable region) antibodies are set forth as SEQ ID NOs: 173 and 194, respectively. Exemplary nucleic acids encoding the mature heavy chains of 17C8.IgG1.1 and 17C8.IgG1.3 antibodies are set forth as SEQ ID NOs: 140 and 154, respectively, and an exemplary nucleic acid encoding the mature light chain of 17C8.IgG1.1 and 17C8.IgG1.3 antibodies is set forth as SEQ ID NO: 163.

Exemplary nucleic acids encoding the mature VH and VL domains of 14H7.IgG1.1 and 14H7.IgG1.3 (same variable region) antibodies are set forth as SEQ ID NOs: 420 and 427, respectively. Exemplary nucleic acids encoding the mature heavy chains of 14H7.IgG1.1 and 14H7.IgG1.3 antibodies are set forth as SEQ ID NOs: 430 and 432, respectively, and an exemplary nucleic acid encoding the mature light chain of 14H7.IgG1.1 and 14H7.IgG1.3 antibodies is set forth as SEQ ID NO: 442.

Exemplary nucleic acids encoding the mature VH and VL domains of 23B3.IgG1.1 and 23B3.IgG1.3 (same variable region) antibodies are set forth as SEQ ID NOs: 421 and 193, respectively. Exemplary nucleic acids encoding the mature heavy chains of 23B3.IgG1.1 and 23B3.IgG1.3 antibodies are set forth as SEQ ID NOs: 432 and 434, respectively, and an exemplary nucleic acid encoding the mature light chain of 23B3.IgG1.1 and 23B3.IgG1.3 antibodies is set forth as SEQ ID NO: 162.

The above exemplary nucleic acids can further include a signal peptide set forth in SEQ ID NOs: 267 to 271 and 361. The nucleotide sequences encoding these signal peptides are set forth as SEQ ID NOs: 272 to 276, 362, and 363.

The nucleic acid molecules described herein may be modified to delete specific sequences, e.g., restriction enzyme recognition sequences, or to optimize codons.

A method for making 13A3 IgG1.1, 8B9 IgG1.1, 8C4 IgG1.1, 17C3 IgG1.1, 9F6 IgG1.1, 3G4 IgG1.1, 17C8 IgG1.1, 14H7 IgG1.1, 23B3 IgG1.1, and/or TIM3.2 to TIM3.18, TIM3.20, TIM3.21, TIM3.22, TIM3.23, TIM3.24, and TIM3.25 IgG1.1 can comprise expressing the heavy chain and the light chains in a cell line comprising the nucleotide sequences encoding the heavy and light chains with a signal peptide, e.g., for 13A3 IgG1.1, SEQ ID NOs: 269 and 268, respectively. A method for making 13A3 IgG1.3, 8B9 IgG1.3, 8C4 IgG1.3, 17C3 IgG1.3, 9F6 IgG1.3, 3G4 IgG1.3, 17C8 IgG1.3, 14H7 IgG1.3, 23B3 IgG1.3, and/or TIM3.2 to TIM3.18, TIM3.20, TIM3.21, TIM3.22, TIM3.23, TIM3.24, and TIM3.25 IgG1.3 can comprise expressing the heavy chain and the light chains in a cell line comprising the nucleotide sequences encoding the heavy and light chains with a signal peptide, e.g., for 13A3 IgG1.3, SEQ ID NOs: 274 and 273, respectively. Host cells comprising these nucleotide sequences are encompassed herein.

Once DNA fragments encoding VH and VL segments are obtained, these DNA fragments can be further manipulated by standard recombinant DNA techniques, for example to convert the variable region genes to full-length antibody chain genes, to Fab fragment genes or to a scFv gene. In these manipulations, a VL- or VH-encoding DNA fragment is operatively linked to another DNA fragment encoding another protein, such as an antibody constant region or a flexible linker. The term "operatively linked", as used in this context, is intended to mean that the two DNA fragments are joined such that the amino acid sequences encoded by the two DNA fragments remain in-frame.

The isolated DNA encoding the VH region can be converted to a full-length heavy chain gene by operatively linking the VH-encoding DNA to another DNA molecule encoding heavy chain constant regions (hinge, CH1, CH2, and/or CH3). The sequences of human heavy chain constant region genes are known in the art (see, e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The heavy chain constant region can be an IgG1, IgG2, IgG3, IgG4, IgA, IgE, IgM or IgD constant region, for example, an IgG1 region. For a Fab fragment heavy chain gene, the VH-encoding DNA can be operatively linked to another DNA molecule encoding only the heavy chain CH1 constant region.

The isolated DNA encoding the VL region can be converted to a full-length light chain gene (as well as a Fab light chain gene) by operatively linking the VL-encoding DNA to another DNA molecule encoding the light chain constant region, CL. The sequences of human light chain constant region genes are known in the art (see, e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The light chain constant region can be a kappa or lambda constant region.

To create a scFv gene, the VH- and VL-encoding DNA fragments are operatively linked to another fragment encoding a flexible linker, e.g., encoding the amino acid sequence $(Gly_4-Ser)_3$, such that the VH and VL sequences can be expressed as a contiguous single-chain protein, with the VL and VH regions joined by the flexible linker (see, e.g., Bird et al., (1988) *Science* 242:423-426; Huston et al., (1988) *Proc. Natl. Acad. Sci. USA* 85:5879-5883; McCafferty et al., (1990) *Nature* 348:552-554).

Also provided herein are nucleic acid molecules encoding VH and VL sequences that are homologous to those of the 17C3, 8B9, 8C4, 3G4, 17C8, 9F6, 13A3, 14H7, 23B3, and any of TIM3.2 to TIM3.18, TIM3.20, TIM3.21, TIM3.22, TIM3.23, TIM3.24, and TIM3.25 antibodies. Exemplary nucleic acid molecules encode VH and VL sequences that are at least 70% identical, for example, at least 75%, at least 80%, at least 85%, at least 90%, at least 95%, or at least 99% identical, to nucleic acid molecules encoding the VH and VL sequences of the 17C3, 8B9, 8C4, 3G4, 17C8, 9F6, 13A3, 14H7, 23B3, or any of TIM3.2 to TIM3.18, TIM3.20, TIM3.21, TIM3.22, TIM3.23, TIM3.24, and TIM3.25 antibodies. Also provided herein are nucleic acid molecules with conservative substitutions (i.e., substitutions that do not alter the resulting amino acid sequence upon translation of nucleic acid molecule), e.g., for codon optimization.

Also provided are nucleic acids encoding the VH and/or VL regions of anti-TIM3 antibodies, such as the anti-TIM3 antibodies described herein, which nucleic acids comprise a nucleotide sequence that is at least about 75%, 80%, 85%, 90%, 95%, %%, 97%, 98% or 99% identical to any of the nucleotide sequences encoding the VH and/or VL regions of anti-TIM3 antibodies described herein.

Also provided are nucleic acids encoding the heavy chain and/or the light chain of anti-TIM3 antibodies, such as the anti-TIM3 antibodies described herein, which nucleic acids comprise a nucleotide sequence that is at least about 75%, 80%, 85%, 90%, 95%, %%, 97%, 98% or 99% identical to any of the nucleotide sequences encoding the heavy and/or light chains of anti-TIM3 antibodies described herein.

XI. Antibody Production

Monoclonal anti-TIM3 antibodies described herein can be produced using a variety of known techniques, such as the standard somatic cell hybridization technique described by Kohler and Milstein, *Nature* 256: 495 (1975). Although somatic cell hybridization procedures are preferred, in principle, other techniques for producing monoclonal antibodies also can be employed, e.g., viral or oncogenic transformation of B lymphocytes, phage display technique using libraries of human antibody genes.

The preferred animal system for preparing hybridomas is the murine system. Hybridoma production in the mouse is a very well-established procedure. Immunization protocols and techniques for isolation of immunized splenocytes for fusion are known in the art. Fusion partners (e.g., murine myeloma cells) and fusion procedures are also known.

Chimeric or humanized anti-TIM3 antibodies described herein can be prepared based on the sequence of a murine monoclonal antibody prepared as described above. DNA encoding the heavy and light chain immunoglobulins can be obtained from the murine hybridoma of interest and engineered to contain non-murine (e.g., human) immunoglobulin sequences using standard molecular biology techniques. For example, to create a chimeric antibody, the murine variable regions can be linked to human constant regions using methods known in the art (see, e.g., U.S. Pat. No. 4,816,567 to Cabilly et al.). To create a humanized antibody, the murine CDR regions can be inserted into a human framework using methods known in the art (see, e.g., U.S. Pat. No. 5,225,539 to Winter, and U.S. Pat. Nos. 5,530,101; 5,585,089; 5,693,762 and 6,180,370 to Queen et al).

In some embodiments, the anti-TIM3 antibodies described herein are human monoclonal antibodies. Such human monoclonal antibodies directed against TIM3 can be generated using transgenic or transchromosomic mice carrying parts of the human immune system rather than the mouse system. These transgenic and transchromosomic mice include mice referred to herein as HuMAb mice and KM mice, respectively, and are collectively referred to herein as "human Ig mice."

The HUMAB-MOUSE® (Medarex, Inc.) contains human immunoglobulin gene miniloci that encode unrearranged human heavy (and v) and a light chain immunoglobulin sequences, together with targeted mutations that inactivate the endogenous s and i chain loci (see, e.g., Lonberg, et al., (1994) *Nature* 368(6474): 856-859). Accordingly, the mice exhibit reduced expression of mouse IgM or r, and in response to immunization, the introduced human heavy and light chain transgenes undergo class switching and somatic mutation to generate high affinity human IgGK monoclonal (Lonberg, N. et al. (1994), supra; reviewed in Lonberg, N. (1994) Handbook of Experimental Pharmacology 113:49-101; Lonberg, N. and Huszar, D. (1995) *Intern. Rev. Immunol.* 13: 65-93, and Harding, F. and Lonberg, N. (1995)*Ann. N.Y. Acad. Sci.* 764:536-546). The preparation and use of HuMab mice, and the genomic modifications carried by such mice, is further described in Taylor, L. et al. (1992) *Nucleic Acids Research* 20:6287-6295; Chen, J. et al., (1993) *International Immunology* 5: 647-656; Tuaillon et al. (1993) *Proc. Natl. Acad. Sci. USA* 90:3720-3724; Choi et al. (1993) *Nature Genetics* 4:117-123; Chen, J. et al. (1993) *EMBO J.* 12: 821-830; Tuaillon et al. (1994) *Immunol.* 152:2912-2920; Taylor, L. et al. (1994) *International Immunology* 6: 579-591; and Fishwild, D. et al. (1996) *Nature Biotechnology* 14: 845-851. See further, U.S. Pat. Nos. 5,545,806; 5,569,825; 5,625,126; 5,633,425; 5,789,650; 5,877,397; 5,661,016; 5,814,318; 5,874,299; and 5,770,429; all to Lonberg and Kay; U.S. Pat. No. 5,545,807 to Surani et al.; PCT Publication Nos. WO 92/03918, WO 93/12227, WO 94/25585, WO 97/13852, WO 98/24884 and WO 99/45962, all to Lonberg and Kay; and PCT Publication No. WO 01/14424 to Korman et al.

In some embodiments, the anti-TIM3 antibodies described herein are raised using a mouse that carries human immunoglobulin sequences on transgenes and transchromosome, such as a mouse that carries a human heavy chain transgene and a human light chain transchromosome. Such mice, referred to herein as "KM mice", are described in detail in PCT Publication WO 02/43478 to Ishida et al.

Still further, alternative transgenic animal systems expressing human immunoglobulin genes are available in the art and can be used to raise anti-TIM3 antibodies described herein. For example, an alternative transgenic system referred to as the Xenomouse (Abgenix, Inc.) can be used; such mice are described in, for example, U.S. Pat. Nos. 5,939,598; 6,075,181; 6,114,598; 6,150,584 and 6,162,963 to Kucherlapati et al.

Moreover, alternative transchromosomic animal systems expressing human immunoglobulin genes are available in the art and can be used to raise anti-TIM3 antibodies described herein. For example, mice carrying both a human heavy chain transchromosome and a human light chain transchromosome, referred to as "TC mice" can be used; such mice are described in Tomizuka et al. (2000) *Proc. Natl. Acad. Sci. USA* 97:722-727. Furthermore, cows carrying human heavy and light chain transchromosome have been described in the art (Kuroiwa et al. (2002) *Nature Biotechnology* 20:889-894) and can be used to raise anti-TIM3 antibodies described herein.

Additional mouse systems described in the art for raising human antibodies, e.g., human anti-TIM3 antibodies, include (i) the VELOCLMMUNE® mouse (Regeneron Pharmaceuticals, Inc.), in which the endogenous mouse heavy and light chain variable regions have been replaced, via homologous recombination, with human heavy and light chain variable regions, operatively linked to the endogenous mouse constant regions, such that chimeric antibodies (human V/mouse C) are raised in the mice, and then subsequently converted to fully human antibodies using standard recombinant DNA techniques; and (ii) the MEMO® mouse (Merus Biopharmaceuticals, Inc.), in which the mouse contains unrearranged human heavy chain variable regions but a single rearranged human common light chain variable region. Such mice, and use thereof to raise antibodies, are described in, for example, WO 2009/15777, US 2010/0069614, WO 2011/072204, WO 2011/097603, WO 2011/163311, WO 2011/163314, WO 2012/148873, US 2012/0070861 and US 2012/0073004.

Human monoclonal anti-TIM3 antibodies described herein can also be prepared using phage display methods for screening libraries of human immunoglobulin genes. Such phage display methods for isolating human antibodies are established in the art. See for example: U.S. Pat. Nos. 5,223,409; 5,403,484; and U.S. Pat. No. 5,571,698 to Ladner et al.; U.S. Pat. Nos. 5,427,908 and 5,580,717 to Dower et al.; U.S. Pat. Nos. 5,969,108 and 6,172,197 to McCafferty et al.; and U.S. Pat. Nos. 5,885,793; 6,521,404; 6,544,731; 6,555,313; 6,582,915 and 6,593,081 to Griffiths et al.

Human monoclonal anti-TIM3 antibodies described herein can also be prepared using SCID mice into which human immune cells have been reconstituted such that a human antibody response can be generated upon immunization. Such mice are described in, for example, U.S. Pat. Nos. 5,476,996 and 5,698,767 to Wilson et al.

XI.A. Immunizations

To generate fully human antibodies to TIM3, transgenic or transchromosomal mice containing human immunoglobulin genes (e.g., HCol2, HCo7 or KM mice) can be immunized with a purified or enriched preparation of the TIM3 antigen and/or cells expressing TIM3 or fragment thereof, as described for other antigens, for example, by Lonberg et al., (1994) *Nature* 368(6474): 856-859; Fishwild et al., (1996) *Nature Biotechnology* 14: 845-851 and WO 98/24884. Alternatively, mice can be immunized with DNA encoding human TIM3 or fragment thereof. In some embodiments, the mice can be 6-16 weeks of age upon the first infusion. For example, a purified or enriched preparation (5-50 pg) of the recombinant TIM3 antigen can be used to immunize the HuMAb mice intraperitoneally. In the event that immunizations using a purified or enriched preparation of the TIM3 antigen do not result in antibodies, mice can also be immunized with cells expressing TIM3, e.g., a cell line, to promote immune responses. Exemplary cell lines include TIM3-overexpressing stable CHO and Raji cell lines.

Cumulative experience with various antigens has shown that the HuMAb transgenic mice respond best when initially immunized intraperitoneally (IP) or subcutaneously (SC) with antigen in Ribi's adjuvant, followed by every other week IP/SC immunizations (up to a total of 10) with antigen in Ribi's adjuvant. The immune response can be monitored over the course of the immunization protocol with plasma samples being obtained by retroorbital bleeds. The plasma can be screened by ELISA and FACS (as described below), and mice with sufficient titers of anti-TIM3 human immunoglobulin can be used for fusions. Mice can be boosted intravenously with antigen 3 days before sacrifice and removal of the spleen and lymph nodes. It is expected that 2-3 fusions for each immunization can need to be performed. Between 6 and 24 mice are typically immunized for each antigen. Usually, HCo7, HCol2, and KM strains are used. In addition, both HCo7 and HCol2 transgene can be bred together into a single mouse having two different human heavy chain transgenes (HCo7/HCol2).

XI.B. Generation of Hybridomas Producing Monoclonal Antibodies to TIM3

To generate hybridomas producing human monoclonal anti-TIM3 antibodies described herein, splenocytes and/or lymph node cells from immunized mice can be isolated and fused to an appropriate immortalized cell line, such as a mouse myeloma cell line. The resulting hybridomas can be screened for the production of antigen-specific antibodies. For example, single cell suspensions of splenic lymphocytes from immunized mice can be fused to Sp2/0 nonsecreting mouse myeloma cells (ATCC, CRL 1581) with PEG. Cells can be plated in flat bottom microtiter plate, followed by incubation in selective medium. After several weeks, cells can be cultured in medium. Individual wells can then be screened by ELISA for human monoclonal IgM and IgG antibodies. Once extensive hybridoma growth occurs, medium can be observed usually after 10-14 days. The antibody secreting hybridomas can be replaced, screened again, and if still positive for human IgG, the monoclonal antibodies can be subcloned at least twice by limiting dilution. The stable subclones can then be cultured in vitro to generate small amounts of antibody in tissue culture medium for characterization.

To purify human monoclonal antibodies, selected hybridomas can be grown in two-liter spinner-flasks for monoclonal antibody purification. Supernatants can be filtered and concentrated before affinity chromatography with protein A-sepharose (Pharmacia, Piscataway, N.J.). Eluted IgG can be checked by gel electrophoresis and high performance liquid chromatography to ensure purity. The buffer solution can be exchanged into PBS, and the concentration can be determined by OD280 using 1.43 extinction coefficient. The monoclonal antibodies can be aliquoted and stored.

XI.C. Generation of Transfectomas Producing Monoclonal Antibodies to TIM3

Antibodies can be produced in a host cell transfectoma using, for example, a combination of recombinant DNA techniques and gene transfection methods as is well known in the art (Morrison, S. (1985) *Science* 229: 1202).

For example, to express antibodies, or antibody fragments thereof, DNAs encoding partial or full-length light and heavy chains, can be obtained by standard molecular biology techniques (e.g., PCR amplification or cDNA cloning using a hybridoma that expresses the antibody of interest) and the DNAs can be inserted into expression vectors such that the genes are operatively linked to transcriptional and translational control sequences. In this context, the term "operatively linked" is intended to mean that an antibody gene is ligated into a vector such that transcriptional and translational control sequences within the vector serve their intended function of regulating the transcription and translation of the antibody gene. The expression vector and expression control sequences are chosen to be compatible with the expression host cell used. The antibody light chain gene and the antibody heavy chain gene can be inserted into separate vector or both genes are inserted into the same expression vector. The antibody genes are inserted into the expression vector(s) by standard methods (e.g., ligation of complementary restriction sites on the antibody gene fragment and vector, or blunt end ligation if no restriction sites are present). The light and heavy chain variable regions of the anti-TIM3 antibodies described herein can be used to create full-length antibody genes of any antibody isotype by inserting them into expression vectors already encoding heavy chain constant and light chain constant regions of the desired isotype such that the $V_H$ segment is operatively linked to the $C_H$ segment(s) within the vector and the $V_L$ segment is operatively linked to the $C_L$ segment within the vector.

Additionally or alternatively, the recombinant expression vector can encode a signal peptide that facilitates secretion of the antibody chain from a host cell. The antibody chain gene can be cloned into the vector such that the signal peptide is linked in-frame to the amino terminus of the antibody chain gene. The signal peptide can be an immunoglobulin signal peptide or a heterologous signal peptide (i.e., a signal peptide from a non-immunoglobulin protein).

In some embodiments, the following signal peptides from human antibody heavy and light chains can be used: MDWTWRVFCLLAVAPGAHS (SEQ ID NO: 267); METPAQLLFLLLLWLPDTTG (SEQ ID NO: 268); MKHLWFFLLLVAAPRWVLS (SEQ ID NO: 269); MEFGLSWVFLVAIIKGVQC (SEQ ID NO: 270); MDMRVPAQLLGLLLWLPGARC (SEQ ID NO: 271) or MRAWIFFLLCLAGRALA (SEQ ID NO: 361). In some embodiments, a signal sequence used for expression of any one of the anti-TIM3 antibodies described herein is SEQ ID NO: 361. Heavy and light chains of anti-TIM3 antibodies can be expressed with the respective signal sequence that was linked to each chain in the hybridoma from which they were cloned. Below are the signal sequences of various anti-TIM3 antibodies as present in the hybridoma from which they were cloned, which signal sequences can be used to express the same antibody or another antibody:

```
(i) Amino acid sequence of 13A3 VH signal sequence:
                                         (SEQ ID NO: 269)
MKHLWFFLLLVAAPRWVLS (ii) Nucleic acid sequence of 13A3 VH signal sequence:
                                         (SEQ ID NO: 274)
ATGAAGCACCTGTGGTTCTTCCTCCTGCTGGTGGCGGCTCCCAGATGGGTCCTGTCC (iii) Amino acid sequence of 13A3 VL signal sequence:
                                         (SEQ ID NO: 268)
METPAQLLFLLLLWLPDTTG (iv) Nucleic acid sequence of 13A3 VL signal sequence:
                                         (SEQ ID NO: 273)
ATGGAAACCCCAGCGCAGCTTCTCTTCCTCCTGCTACTCTGGCTCCCAGATACCACCGGA (v) Amino acid sequence of 8B9 VH signal sequence:
                                         (SEQ ID NO: 269)
MKHLWFFLLLVAAPRWVLS (vi) Nucleic acid sequence of 8B9 VH signal sequence:
                                         (SEQ ID NO: 274)
ATGAAGCACCTGTGGTTCTTCCTCCTGCTGGTGGCGGCTCCCAGATGGGTCCTGTCC (vii) Amino acid sequence of 8B9 VL signal sequence:
                                         (SEQ ID NO: 268)
METPAQLLFLLLLWLPDTTG (viii) Nucleic acid sequence of 8B9 VL signal sequence:
                                         (SEQ ID NO: 273)
ATGGAAACCCCAGCGCAGCTTCTCTTCCTCCTGCTACTCTGGCTCCCAGATACCACCGGA (ix) Amino acid sequence of 8C4 VH signal sequence:
                                         (SEQ ID NO: 269)
MKHLWFFLLLVAAPRWVLS (x) Nucleic acid sequence of 8C4 VH signal sequence:
                                         (SEQ ID NO: 274)
ATGAAGCACCTGTGGTTCTTCCTCCTGCTGGTGGCGGCTCCCAGATGGGTCCTGTCC (xi) Amino acid sequence of 8C4 VL signal sequence:
                                         (SEQ ID NO: 268)
METPAQLLFLLLLWLPDTTG (xii) Nucleic acid sequence of 8C4 VL signal sequence:
                                         (SEQ ID NO: 273)
ATGGAAACCCCAGCGCAGCTTCTCTTCCTCCTGCTACTCTGGCTCCCAGATACCACCGGA
```

-continued (xiii) Amino acid sequence of 17C3 VH signal sequence:
(SEQ ID NO: 267)
MDWTWRVFCLLAVAPGAHS (xiv) Nucleic acid sequence of 17C3 VH signal sequence:
(SEQ ID NO: 272)
ATGGAAACCCCAGCGCAGCTTCTCTTCCTCCTGCTACTCTGGCTCCCAGATACCACCGGA (xv) Amino acid sequence of 17C3 VL signal sequence:
(SEQ ID NO: 268)
METPAQLLFLLLLWLPDTTG (xvi) Nucleic acid sequence of 17C3 VL signal sequence:
(SEQ ID NO: 273)
ATGGAAACCCCAGCGCAGCTTCTCTTCCTCCTGCTACTCTGGCTCCCAGATACCACCGGA (xvii) Amino acid sequence of 9F6 VH signal sequence:
(SEQ ID NO: 270)
MEFGLSWVFLVAIIKGVQC (xviii) Nucleic acid sequence of 9F6 VH signal sequence:
(SEQ ID NO: 275)
ATGGAAACCCCAGCGCAGCTTCTCTTCCTCCTGCTACTCTGGCTCCCAGATACCACCGGA (xix) Amino acid sequence of 9F6 VL1 signal sequence:
(SEQ ID NO: 271)
MDMRVPAQLLGLLLLWLPGARC (xx) Nucleic acid sequence of 9F6 VL1 signal sequence:
(SEQ ID NO: 276)
ATGGACATGAGGGTCCCCGCTCAGCTCCTGGGGCTTCTGCTGCTCTGGCTCCCAGGTGCC

AGATGT (xxi) Amino acid sequence of 9F6 VL2 and VL3 signal sequence:
(SEQ ID NO: 268)
METPAQLLFLLLLWLPDTTG (xxii) Nucleic acid sequence of 9F6 VL2 and VL3 signal sequence:
(SEQ ID NO: 273)
ATGGAAACCCCAGCGCAGCTTCTCTTCCTCCTGCTACTCTGGCTCCCAGATACCACCGGA (xxiii) Amino acid sequence of 3G4 VH signal sequence:
(SEQ ID NO: 270)
MEFGLSWVFLVAIIKGVQC (xxiv) Nucleic acid sequence of 3G4 VH signal sequence:
(SEQ ID NO: 275)
ATGGAAACCCCAGCGCAGCTTCTCTTCCTCCTGCTACTCTGGCTCCCAGATACCACCGGA (xxv) Amino acid sequence of 3G4 VL signal sequence:
(SEQ ID NO: 268)
METPAQLLFLLLLWLPDTTG (xxvi) Nucleic acid sequence of 3G4 VL signal sequence:
(SEQ ID NO: 273)
ATGGAAACCCCAGCGCAGCTTCTCTTCCTCCTGCTACTCTGGCTCCCAGATACCACCGGA (xxvii) Amino acid sequence of 17C8 VH signal sequence:
(SEQ ID NO: 270)
MEFGLSWVFLVAIIKGVQC (xxviii) Nucleic acid sequence of 17C8 VH signal sequence:
(SEQ ID NO: 275)
ATGGAAACCCCAGCGCAGCTTCTCTTCCTCCTGCTACTCTGGCTCCCAGATACCACCGGA (xxix) Amino acid sequence of 17C8 VL signal sequence:
(SEQ ID NO: 268)
METPAQLLFLLLLWLPDTTG (xxx) Nucleic acid sequence of 17C8 VL signal sequence:
(SEQ ID NO: 273)
ATGGAAACCCCAGCGCAGCTTCTCTTCCTCCTGCTACTCTGGCTCCCAGATACCACC

GGA.

In some embodiments, the heavy and light chains of the anti-TIM3 antibodies (e.g., TIM3.2 to TIM3.18) can be engineered with signal sequences that differ from those present in the hybridomas from which they were cloned. Examples of such sequences include, but not limited to, the following:

(i) Nucleic acid sequence of signal sequence
for the heavy chain:
(SEQ ID NO: 362)
ATGAGGGCTIGGATCTTCTTTCTGCTCTGCCTGGCCGGGAGAGCGCTCGC
A (ii) Nucleic acid sequence of signal sequence
for the light chain:
(SEQ ID NO: 363)
ATGAGGGCTIGGATCTTCTTTCTGCTCTGCCTGGCCGGGCGCGCCTTGGC
C (iii) Amino acid sequence of signal sequence
for the heavy and light chains:
(SEQ ID NO: 361)
MRAWIFFLLCLAGRALA.

In addition to the antibody chain genes, recombinant expression vectors can carry regulatory sequences that control the expression of the antibody chain genes in a host cell. The term "regulatory sequence" is intended to include promoters, enhancers and other expression control elements (e.g., polyadenylation signals) that control the transcription or translation of the antibody chain genes. Such regulatory sequences are described, for example, in Goeddel (Gene Expression Technology. Methods in Enzymology 185, Academic Press, San Diego, CA (1990)). It will be appreciated by those skilled in the art that the design of the expression vector, including the selection of regulatory sequences, can depend on such factors as the choice of the host cell to be transformed, the level of expression of protein desired, etc. Preferred regulatory sequences for mammalian host cell expression include viral elements that direct high levels of protein expression in mammalian cells, such as promoters and/or enhancers derived from cytomegalovirus (CMV), Simian Virus 40 (SV40), adenovirus, (e.g., the adenovirus major late promoter (AdMLP) and polyoma. Alternatively, nonviral regulatory sequences can be used, such as the ubiquitin promoter or β-globin promoter. Still further, regulatory elements composed of sequences from different sources, such as the SRa promoter system, which contains sequences from the SV40 early promoter and the long terminal repeat of human T cell leukemia virus type 1 (Takebe, Y. et al. (1988) *Mol. Cell. Biol.* 8:466472).

In addition to the antibody chain genes and regulatory sequences, recombinant expression vectors can carry additional sequences, such as sequences that regulate replication of the vector in host cells (e.g., origins of replication) and selectable marker genes. The selectable marker gene facilitates selection of host cells into which the vector has been introduced (see, e.g., U.S. Pat. Nos. 4,399,216, 4,634,665 and 5,179,017, all by Axel et al). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr– host cells with methotrexate selection/amplification) and the neo gene (for G418 selection).

For expression of the light and heavy chains, the expression vector(s) encoding the heavy and light chains is transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection and the like.

Although it is theoretically possible to express the anti-TIM3 antibodies described herein in either prokaryotic or eukaryotic host cells, expression of antibodies in eukaryotic cells, and most preferably mammalian host cells, is the most preferred because such eukaryotic cells, and in particular mammalian cells, are more likely than prokaryotic cells to assemble and secrete a properly folded and immunologically active antibody. Prokaryotic expression of antibody genes has been reported to be ineffective for production of high yields of active antibody (Boss, M. A. and Wood, C. R. (1985) *Immunology Today* 6: 12-13).

Certain mammalian host cells for expressing the recombinant anti-TIM3 antibodies described herein include Chinese Hamster Ovary (CHO cells) (including dhfr– CHO cells, described in Urlaub and Chasin, (1980) *Proc. Natl. Acad. Sci. USA* 77:4216-4220, used with a DHFR selectable marker, e.g., as described in R. J. Kaufman and P. A. Sharp (1982) *Mol. Biol.* 759:601-621), NSO myeloma cells, COS cells and SP2 cells. In particular, for use with NSO myeloma cells, another expression system is the GS gene expression system disclosed in WO 87/04462, WO 89/01036 and EP 338,841. When recombinant expression vectors encoding antibody genes are introduced into mammalian host cells, the antibodies are produced by culturing the host cells for a period of time sufficient to allow for expression of the antibody in the host cells or, more preferably, secretion of the antibody into the culture medium in which the host cells are grown. Antibodies can be recovered from the culture medium using standard protein purification methods.

XI. Assays

Anti-TIM3 antibodies described herein can be tested for binding to human TIM3 by, for example, standard ELISA. Briefly, microtiter plates are coated with purified TIM3, and then blocked with bovine serum albumin. Dilutions of antibody (e.g., dilutions of plasma from TIM3-immunized mice) are added to each well and incubated. The plates are washed and incubated with secondary reagent (e.g., for human antibodies, a goat-anti-human IgG Fc-specific polyclonal reagent) conjugated to horseradish peroxidase (HRP). After washing, the plates can be developed and analyzed by a spectrophotometer. Sera from immunized mice can then be further screened by flow cytometry for binding to a cell line expressing human TIM3, but not to a control cell line that does not express TIM3. Briefly, the binding of anti-TIM3 antibodies can be assessed by incubating TIM3 expressing CHO cells with the anti-TIM3 antibody. The cells can be washed and binding can be detected with an anti-human IgG Ab. Flow cytometric analyses can be performed using a FACScan flow cytometry (Becton Dickinson, San Jose, CA). Mice which develop the highest titers can be used for fusions.

An ELISA assay as described above can be used to screen for antibodies and, thus, hybridomas that produce antibodies that show positive reactivity with the TIM3 immunogen. Hybridomas that produce antibodies that bind with high affinity to TIM3 can then be subcloned and further characterized. One clone from each hybridoma, which retains the reactivity of the parent cells (by ELISA), can then be chosen for making a cell bank, and for antibody purification.

To purify anti-TIM3 antibodies, selected hybridomas can be grown for monoclonal antibody purification. Supernatants can be filtered and concentrated before affinity chromatography. Eluted IgG can be checked by gel electrophoresis and high performance liquid chromatography to ensure purity. The buffer solution can be exchanged, and the concentration can be determined. The monoclonal antibodies can be aliquoted and stored.

To determine if the selected anti-TIM3 monoclonal antibodies bind to unique epitopes, each antibody can be biotinylated using commercially available reagents (Pierce, Rockford, IL). Biotinylated MAb binding can be detected with a streptavidin labeled probe. Competition studies using unlabeled monoclonal antibodies and biotinylated monoclonal antibodies can be performed using TIM3 coated-ELISA plates as described above.

To determine the isotype of purified antibodies, isotype ELISAs can be performed using reagents specific for antibodies of a particular isotype. For example, to determine the isotype of a human monoclonal antibody, wells of microtiter plates can be coated with 1 µg/ml of anti-human immunoglobulin overnight at 4° C. After blocking with 1% BSA, the plates are reacted with 1 µg/ml or less of test monoclonal antibodies or purified isotype controls, at ambient temperature for one to two hours. The wells can then be reacted with either human IgG1 or human IgM-specific alkaline phosphatase-conjugated probes. Plates are developed and analyzed as described above.

To test the binding of monoclonal antibodies to live cells expressing TIM3, flow cytometry can be used, as described in the Examples. Briefly, cell lines expressing membrane-bound TIM3 (grown under standard growth conditions) are mixed with various concentrations of monoclonal antibodies in PBS containing 0.1% BSA at 4° C. for 1 hour. After washing, the cells are reacted with Fluorescein-labeled anti-IgG antibody under the same conditions as the primary antibody staining. The samples can be analyzed by FACScan instrument using light and side scatter properties to gate on single cells and binding of the labeled antibodies is determined. An alternative assay using fluorescence microscopy can be used (in addition to or instead of) the flow cytometry assay. Cells can be stained exactly as described above and examined by fluorescence microscopy. This method allows visualization of individual cells, but can have diminished sensitivity depending on the density of the antigen.

Anti-TIM3 antibodies can be further tested for reactivity with the TIM3 antigen by Western blotting. Briefly, cell extracts from cells expressing TIM3 can be prepared and subjected to sodium dodecyl sulfate polyacrylamide gel electrophoresis. After electrophoresis, the separated antigens will be transferred to nitrocellulose membranes, blocked with 20% mouse serum, and probed with the monoclonal antibodies to be tested. IgG binding can be detected using anti-IgG alkaline phosphatase and developed with BCIP/NBT substrate tablets (Sigma Chem. Co., St. Louis, MO).

Methods for analyzing binding affinity, cross-reactivity, and binding kinetics of various anti-TIM3 antibodies include standard assays known in the art, for example, BIACORE™ surface plasmon resonance (SPR) analysis using a BIACORE™ 2000 SPR instrument (Biacore AB, Uppsala, Sweden).

A variety of assays can be used to characterize the biological activity of anti-TIM3 antibodies (which can be used, e.g., for comparing different anti-TIM3 antibodies), such as those described herein:

(1) T cell activation assays, such as assays using purified T cells obtained from PBMCs of human donors. Assays can be conducted with total T cells or subpopulations thereof, e.g., Th1 cells, T cytotoxic cells, Treg cells, CD4+ T cells, CD8+ T cells, provided that they express TIM3. Activation may be measured by determining the level of secretion of certain cytokines, e.g., interferon-γ or IL-2 or the level of proliferation of the T cells. Without wanting to be limited to a particular mechanism of action, binding of TIM3 antibodies to TIM3 on T cells may prevent binding of TIM3 to a TIM3 ligand (TIM3 putative ligands include Galectin-9, HMGB1, Semaphorin4A, CEACAM-1, ILT4 and phosphatidylserine) and thereby prevent TIM3 mediated signaling in the T cell thereby preventing negatively regulation of T cells by TIM3. Exemplary assays, including Th1 assays, TIL assays and mixed lymphocyte reactions (MLRs) are provided in the Examples;

(2) assays measuring stimulation of macrophages, e.g., M1 or M2 macrophage; and (3) assays measuring secretion of myeloid-associated cytokines, e.g., TNFα, IL-1β, GM-CSF, IL-6, IL-2, IL-10, CCL2, CCL3, CCL4 or CCL5 from TIM3 positive myeloid cells. In some embodiments, anti-TIM3 antibodies stimulate the secretion of TNFα, IL-1β, GM-CSF, IL-6, and IL-2 and/or inhibit the secretion of IL-10, CCL2, CCL3, CCL4 or CCL5 from TIM3 positive myeloid cells.

Generally, any method for testing the biological activity of an agent that inhibits immune responses can be used to characterize the biological activity of anti-TIM3 antibodies, e.g., those described in the literature (including patents and patent applications) relating to TIM3.

XIII. Immunoconjugates, Antibody Derivatives and Diagnostics

Anti-TIM3 antibodies described herein can be used for diagnostic purposes, including sample testing and in vivo imaging, and for this purpose the antibody (or antigen binding portion thereof) can be conjugated to an appropriate detectable agent, to form an immunoconjugate. For diagnostic purposes, appropriate agents are detectable labels that include radioisotopes, for whole body imaging, and radioisotopes, enzymes, fluorescent labels and other suitable antibody tags for sample testing.

The detectable labels that can be linked to any TIM3 antibody described herein can be any of the various types used currently in the field of in vitro diagnostics, including particulate labels including metal sols such as colloidal gold, isotopes such as $I^{125}$ or $Tc^{99}$ presented for instance with a peptidic chelating agent of the $N_2S_2$, $N_3S$ or $N_4$ type, chromophores including fluorescent markers, luminescent markers, phosphorescent markers and the like, as well as enzyme labels that convert a given substrate to a detectable marker, and polynucleotide tags that are revealed following amplification such as by polymerase chain reaction. Suitable enzyme labels include horseradish peroxidase, alkaline phosphatase and the like. For instance, the label can be the enzyme alkaline phosphatase, detected by measuring the presence or formation of chemiluminescence following conversion of 1,2 dioxetane substrates such as adamantyl methoxy phosphoryloxy phenyl dioxetane (AMPPD), disodium 3-(4-(methoxyspiro{1,2-dioxetane-3,2'-(5'-chloro)tricyclo{3.3.1.1 3,7}decan}-4-yl)phenyl phosphate (CSPD), as well as CDP and CDP-STAR® or other luminescent substrates well-known to those in the art, for example the chelates of suitable lanthanides such as Terbium(III) and Europium(III). The detection means is determined by the chosen label. Appearance of the label or its reaction products can be achieved using the naked eye, in the case where the label is particulate and accumulates at appropriate levels, or using instruments such as a spectrophotometer, a luminometer, a fluorimeter, and the like, all in accordance with standard practice.

In some embodiments, conjugation methods result in linkages which are substantially (or nearly) non-immunogenic, e.g., peptide- (i.e., amide-), sulfide-, (sterically hindered), disulfide-, hydrazone-, and ether linkages. These linkages are nearly non-immunogenic and show reasonable stability within serum (see e.g., Senter, P. D., *Curr. Opin. Chem. Biol.* 13 (2009) 235-244; WO 2009/059278; WO 95/17886).

Depending on the biochemical nature of the moiety and the antibody, different conjugation strategies can be employed. In case the moiety is naturally-occurring or recombinant of between 50 to 500 amino acids, there are standard procedures in text books describing the chemistry for synthesis of protein conjugates, which can be easily followed by the skilled artisan (see, e.g., Hackenberger, C. P. R., and Schwarzer, D., *Angew. Chem. Int. Ed. Engl.* 47 (2008) 10030-10074). In some embodiments the reaction of a maleinimido moiety with a cysteine residue within the antibody or the moiety is used. This is an especially suited coupling chemistry in case e.g., a Fab or Fab'-fragment of an antibody is used. Alternatively, in some embodiments, coupling to the C-terminal end of the antibody or moiety is performed. C-terminal modification of a protein, e.g., of a Fab-fragment, can be performed as described (Sunbul, M. and Yin, J., *Org. Biomol. Chem.* 7 (2009) 3361-3371).

In general, site specific reaction and covalent coupling is based on transforming a natural amino acid into an amino acid with a reactivity which is orthogonal to the reactivity of the other functional groups present. For example, a specific cysteine within a rare sequence context can be enzymatically converted in an aldehyde (see Frese, M. A., and Dierks, T., *ChemBioChem.* 10 (2009) 425-427). It is also possible to obtain a desired amino acid modification by utilizing the specific enzymatic reactivity of certain enzymes with a natural amino acid in a given sequence context (see, e.g., Taki, M. et al., *Prot. Eng. Des. Sel.* 17 (2004) 119-126; Gautier, A. et al. *Chem. Biol.* 15 (2008) 128-136; and Protease-catalyzed formation of C—N bonds is used by Bordusa, F., Highlights in Bioorganic Chemistry (2004) 389-403). Site specific reaction and covalent coupling can also be achieved by the selective reaction of terminal amino acids with appropriate modifying reagents.

The reactivity of an N-terminal cysteine with benzonitrils (see Ren, H. et al., *Angew. Chem. Int. Ed. Engl.* 48 (2009) 9658-9662) can be used to achieve a site-specific covalent coupling.

Native chemical ligation can also rely on C-terminal cysteine residues (Taylor, E. Vogel; Imperiali, B, *Nucleic Acids and Molecular Biology* (2009), 22 (Protein Engineering), 65-96).

U.S. Pat. No. 6,437,095 B1 describes a conjugation method which is based on the faster reaction of a cysteine within a stretch of negatively charged amino acids with a cysteine located in a stretch of positively charged amino acids.

The moiety can also be a synthetic peptide or peptide mimic. In case a polypeptide is chemically synthesized, amino acids with orthogonal chemical reactivity can be incorporated during such synthesis (see e.g., de Graaf, A. J. et al., *Bioconjug. Chem.* 20 (2009) 1281-1295). Since a great variety of orthogonal functional groups is at stake and can be introduced into a synthetic peptide, conjugation of such peptide to a linker is standard chemistry.

In order to obtain a mono-labeled polypeptide, the conjugate with 1:1 stoichiometry can be separated by chromatography from other conjugation side-products. This procedure can be facilitated by using a dye labeled binding pair member and a charged linker. By using this kind of labeled and highly negatively charged binding pair member, mono conjugated polypeptides are easily separated from non-labeled polypeptides and polypeptides which carry more than one linker, since the difference in charge and molecular weight can be used for separation. The fluorescent dye can be useful for purifying the complex from un-bound components, like a labeled monovalent binder.

In some embodiments the moiety attached to an anti-TIM3 antibody is selected from the group consisting of a binding moiety, a labeling moiety, and a biologically active moiety.

Anti-TIM3 antibodies described herein can also be conjugated to a therapeutic agent to form an immunoconjugate such as an antibody-drug conjugate (ADC). Suitable therapeutic agents include antimetabolites, alkylating agents, DNA minor groove binders, DNA intercalators, DNA cross-linkers, histone deacetylase inhibitors, nuclear export inhibitors, proteasome inhibitors, topoisomerase I or II inhibitors, heat shock protein inhibitors, tyrosine kinase inhibitors, antibiotics, and anti-mitotic agents. In the ADC, the antibody and therapeutic agent preferably are conjugated via a linker cleavable such as a peptidyl, disulfide, or hydrazone linker. In some embodiments, the linker is a peptidyl linker such as Val-Cit, Ala-Val, Val-Ala-Val, Lys-Lys, Pro-Val-Gly-Val-Val (SEQ ID NO: 300), Ala-Asn-Val, Val-Leu-Lys, Ala-Ala-Asn, Cit-Cit, Val-Lys, Lys, Cit, Ser, or Glu. The ADCs can be prepared as described in U.S. Pat. Nos. 7,087,600; 6,989,452; and 7,129,261; PCT Publications WO 02/096910; WO 07/038658; WO 07/051081; WO 07/059404; WO 08/083312; and WO 08/103693; U.S. Patent Publications 20060024317; 20060004081; and 20060247295.

Anti-TIM3 antibodies, e.g., those described herein, can also be used for detecting TIM3, such as human TIM3, e.g., human TIM3 in tissues or tissue samples. The antibodies can be used, e.g., in an ELISA assay or in flow cytometry. In some embodiments, an anti-TIM3 antibody is contacted with cells, e.g., cells in a tissue, for a time appropriate for specific binding to occur, and then a reagent, e.g., an antibody that detects the anti-TIM3 antibody, is added. Exemplary assays are provided in the Examples. The anti-TIM3 antibody can be a fully human antibody, or it can be a chimeric antibody, such as an antibody having human variable regions and murine constant regions or a portion thereof. Exemplary methods for detecting TIM3, e.g., human TIM3, in a sample (cell or tissue sample) comprise (i) contacting a sample with an anti-TIM3 antibody, for a time sufficient for allowing specific binding of the anti-TIM3 antibody to TIM3 in the sample, and (2) contacting the sample with a detection reagent, e.g., an antibody, that specifically binds to the anti-TIM3 antibody, such as to the Fc region of the anti-TIM3 antibody, to thereby detect TIM3 bound by the anti-TIM3 antibody. Wash steps can be included after the incubation with the antibody and/or detection reagent. Anti-TIM3 antibodies for use in these methods do not have to be linked to a label or detection agents, as a separate detection agent can be used.

Other uses for anti-TIM3 antibodies, e.g., as monotherapy or combination therapy, are provided elsewhere herein, e.g., in the section pertaining to combination treatments.

XIV. Bispecific Molecules

Anti-TIM3 antibodies described herein can be used for forming bispecific molecules. An anti-TIM3 antibody, or antigen binding portion thereof, can be derivatized or linked to another functional molecule, e.g., another peptide or protein (e.g., another antibody or ligand for a receptor) to generate a bispecific molecule that binds to at least two different binding sites or target molecules. For example, an anti-TIM3 antibody can be linked to an antibody or scFv that binds specifically to any protein that can be used as potential targets for combination treatments, such as the proteins described herein (e.g., antibodies to PD-1, PD-L1, GITR, or LAG-3). The antibody described herein can in fact be derived or linked to more than one other functional molecule to generate multispecific molecules that bind to more than two different binding sites and/or target molecules; such multispecific molecules are also intended to be encompassed by the term "bispecific molecule" as used herein. To create a bispecific molecule described herein, an antibody described herein can be functionally linked (e.g., by chemical coupling, genetic fusion, noncovalent association or otherwise) to one or more other binding molecules, such as another antibody, antibody fragment, peptide or binding mimetic, such that a bispecific molecule results.

Accordingly, provided herein are bispecific molecules comprising at least one first binding specificity for TIM3 and a second binding specificity for a second target epitope. In some embodiments described herein in which the bispecific molecule is multispecific, the molecule can further include a third binding specificity.

In some embodiments, the bispecific molecules described herein comprise as a binding specificity at least one antibody, or an antibody fragment thereof, including, e.g., an Fab, Fab', F(ab')2, Fv, or a single chain Fv (scFv). The antibody can also be a light chain or heavy chain dimer, or any minimal fragment thereof such as a Fv or a single chain construct as described in Ladner et al. U.S. Pat. No. 4,946,778.

While human monoclonal antibodies are preferred, other antibodies which can be employed in the bispecific molecules described herein are murine, chimeric and humanized monoclonal antibodies.

The bispecific molecules described herein can be prepared by conjugating the constituent binding specificities using methods known in the art. For example, each binding specificity of the bispecific molecule can be generated separately and then conjugated to one another. When the binding specificities are proteins or peptides, a variety of coupling or cross-linking agents can be used for covalent conjugation. Examples of cross-linking agents include protein A, carbodiimide, N-succinimidyl-S-acetyl-thioacetate (SATA), 5,5'-dithiobis(2-nitrobenzoic acid) (DTNB), o-phenylenedimaleimide (oPDM), N-succinimidyl-3-(2-pyridyldithio)propionate (SPDP), and sulfosuccinimidyl 4-(N-maleimidomethyl) cyclohaxane-1-carboxylate (sulfo-SMCC) (see, e.g., Karpovsky et al. (1984) *J. Exp. Med.* 160: 1686; Liu, M A et al. (1985) *Proc. Natl. Acad. Sci. USA* 82:8648). Other methods include those described in Paulus (1985) *Behring Ins. Mitt. No.* 78, 118-132; Brennan et al. (1985) *Science* 229:81-83), and Glennie et al. (1987) *J. Immunol.* 139: 2367-2375). Some conjugating agents are SATA and sulfo-SMCC, both available from Pierce Chemical Co. (Rockford, IL).

When the binding specificities are antibodies, they can be conjugated via sulfhydryl bonding of the C-terminus hinge regions of the two heavy chains. In some embodiments, the hinge region is modified to contain an odd number of sulfhydryl residues, preferably one, prior to conjugation.

Alternatively, both binding specificities can be encoded in the same vector and expressed and assembled in the same host cell. This method is particularly useful where the bispecific molecule is a mAb×mAb, mAb×Fab, mAb×(scFv)₂, Fab×F(ab)₂ or ligand x Fab fusion protein. A bispecific antibody can comprise an antibody comprising an scFv at the C-terminus of each heavy chain. A bispecific molecule described herein can be a single chain molecule comprising one single chain antibody and a binding determinant, or a single chain bispecific molecule comprising two binding determinants. Bispecific molecules can comprise at least two single chain molecules. Methods for preparing bispecific molecules are described for example in U.S. Pat. Nos. 5,260,203; 5,455,030; 4,881,175; 5,132,405; 5,091,513; 5,476,786; 5,013,653; 5,258,498; and 5,482,858.

Binding of the bispecific molecules to their specific targets can be confirmed using art-recognized methods, such as enzyme-linked immunosorbent assay (ELISA), radioimmunoassay (RIA), FACS analysis, bioassay (e.g., growth inhibition), or Western Blot assay. Each of these assays generally detects the presence of protein-antibody complexes of particular interest by employing a labeled reagent (e.g., an antibody) specific for the complex of interest.

XV. Compositions

Further provided are compositions, e.g., a pharmaceutical compositions, containing one or a combination of anti-TIM3 antibodies or combination with antibodies to other targets, or antigen binding portion(s) thereof, described herein, formulated together with a pharmaceutically acceptable carrier. Such compositions can include one or a combination of (e.g., two or more different) antibodies, or immunoconjugates or bispecific molecules described herein. For example, a pharmaceutical composition described herein can comprise a combination of antibodies (or immunoconjugates or bispecifics) that bind to different epitopes on the target antigen or that have complementary activities.

In some embodiments, a composition comprises an anti-TIM3 antibody at a concentration of at least 1 mg/ml, 5 mg/ml, 10 mg/ml, 50 mg/ml, 100 mg/ml, 150 mg/ml, 200 mg/ml, 1-300 mg/ml, or 100-300 mg/ml.

Pharmaceutical compositions described herein also can be administered in combination therapy, i.e., combined with other agents. For example, the combination therapy can include an anti-TIM3 antibody described herein combined with at least one other anti-cancer and/or immunomodulating, e.g., T-cell stimulating (e.g., activating) agent. Examples of therapeutic agents that can be used in combination therapy are described in greater detail below in the section on uses of the anti-TIM3 antibodies described herein.

In some embodiments, therapeutic compositions disclosed herein can include other compounds, drugs, and/or agents used for the treatment of cancer. Such compounds, drugs, and/or agents can include, for example, chemotherapy drugs, small molecule drugs or antibodies that stimulate the immune response to a given cancer. In some instances, therapeutic compositions can include, for example, one or more of an anti-CTLA-4 antibody, an anti-PD-1 antibody, an anti-PD-L1 antibody, an anti-OX40 (also known as CD134, TNFRSF4, ACT35 and/or TXGP1L) antibody, an anti-CD137 antibody, an anti-LAG-3 antibody, an anti-GITR antibody, or any combination thereof.

As used herein, "pharmaceutically acceptable carrier" includes any and all solvents, dispersion media, coatings, antibacterial and antifungal agents, isotonic and absorption delaying agents, and the like that are physiologically compatible. In some embodiments, the carrier is suitable for intravenous, intramuscular, subcutaneous, parenteral, spinal or epidermal administration (e.g., by injection or infusion). Depending on the route of administration, the active compound, i.e., antibody, immunoconjugate, or bispecific molecule, can be coated in a material to protect the compound from the action of acids and other natural conditions that can inactivate the compound.

The pharmaceutical compounds described herein can include one or more pharmaceutically acceptable salts. A "pharmaceutically acceptable salt" refers to a salt that retains the desired biological activity of the parent compound and does not impart any undesired toxicological effects (see e.g., Berge, S. M., et al. (1977) *J. Pharm. Sci.* 66: 1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

A pharmaceutical composition described herein can also include a pharmaceutically acceptable anti-oxidant. Examples of pharmaceutically acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Examples of suitable aqueous and nonaqueous carriers that can be employed in the pharmaceutical compositions described herein include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions can also contain adjuvants such as preservatives, wetting agents, emulsifying agents and dispersing agents. Prevention of presence of microorganisms can be ensured both by sterilization procedures, supra, and by the inclusion of various antibacterial and antifungal agents, for example, paraben, chlorobutanol, phenol sorbic acid, and the like. It can also be desirable to include isotonic agents, such as sugars, sodium chloride, and the like into the compositions. In addition, prolonged absorption of the injectable pharmaceutical form can be brought about by the inclusion of agents which delay absorption such as aluminum monostearate and gelatin.

Pharmaceutically acceptable carriers include sterile aqueous solutions or dispersions and sterile powders for the extemporaneous preparation of sterile injectable solutions or dispersion. The use of such media and agents for pharmaceutically active substances is known in the art. Except insofar as any conventional media or agent is incompatible with the active compound, use thereof in the pharmaceutical compositions described herein is contemplated. A pharmaceutical composition can comprise a preservative or can be devoid of a preservative. Supplementary active compounds can be incorporated into the compositions.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. In many cases, the compositions can include isotonic agents, for example, sugars, polyalcohols such as mannitol, sorbitol, or sodium chloride in the composition. Prolonged absorption of the injectable compositions can be brought about by including in the composition an agent that delays absorption, for example, monostearate salts and gelatin.

Sterile injectable solutions can be prepared by incorporating the active compound in the required amount in an appropriate solvent with one or a combination of ingredients enumerated above, as required, followed by sterilization microfiltration. Generally, dispersions are prepared by incorporating the active compound into a sterile vehicle that contains a basic dispersion medium and the required other ingredients from those enumerated herein. In the case of sterile powders for the preparation of sterile injectable solutions, some methods of preparation are vacuum drying and freeze-drying (lyophilization) that yield a powder of the active ingredient plus any additional desired ingredient from a previously sterile-filtered solution thereof.

The amount of active ingredient which can be combined with a carrier material to produce a single dosage form will vary depending upon the subject being treated, and the particular mode of administration. The amount of active ingredient which can be combined with a carrier material to produce a single dosage form will generally be that amount of the composition which produces a therapeutic effect. Generally, out of one hundred percent, this amount will range from about 0.01 percent to about ninety-nine percent of active ingredient, from about 0.1 percent to about 70 percent, or from about 1 percent to about 30 percent of active ingredient in combination with a pharmaceutically acceptable carrier.

Dosage regimens are adjusted to provide the optimum desired response (e.g., a therapeutic response). For example, a single bolus can be administered, several divided doses can be administered over time or the dose can be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms described herein are dictated by and directly dependent on (a) the unique characteristics of the active compound and the particular therapeutic effect to be achieved, and (b) the limitations inherent in the art of compounding such an active compound for the treatment of sensitivity in individuals.

For administration of an anti-TIM3 antibody, e.g., described herein, the dosage ranges from about 0.0001 to 100 mg/kg, and more usually 0.01 to 5 or 10 mg/kg, of the host body weight. For example dosages can be 0.3 mg/kg body weight, 1 mg/kg body weight, 3 mg/kg body weight, 5 mg/kg body weight or 10 mg/kg body weight or within the range of 1-10 mg/kg. An exemplary treatment regime entails administration once per week, once every two weeks, once every three weeks, once every four weeks, once a month, once every 3 months or once every three to 6 months. Exemplary dosage regimens for an anti-TIM3 antibody described herein include 1 mg/kg body weight or 3 mg/kg body weight via intravenous administration, with the antibody being given using one of the following dosing schedules: (i) every four weeks for six dosages, then every three months; (ii) every three weeks; (iii) 3 mg/kg body weight once followed by 1 mg/kg body weight every three weeks.

An anti-TIM3 antibody can be administered at a flat dose (flat dose regimen). In some embodiments, an anti-TIM3 antibody can be administered at a fixed dose with another antibody. In some embodiments, an anti-TIM3 antibody is administered at a dose based on body weight In some methods, two or more monoclonal antibodies with different binding specificities are administered simultaneously, in which case the dosage of each antibody administered falls within the ranges indicated. Antibody is usually administered on multiple occasions. Intervals between single dosages can be, for example, weekly, monthly, every three months or yearly. Intervals can also be irregular as indicated by measuring blood levels of antibody to the target antigen in the patient In some methods, dosage is adjusted to achieve a plasma antibody concentration of about 1-1000 µg/ml and in some methods about 25-300 µg/ml.

An anti-TIM3 antibody can be administered with another antibody at the dosage regimen of the other antibody. For example, an anti-TIM3 antibody can be administered with an anti-PD-1 antibody, such as nivolumab (OPDIVO®), every two weeks as an i.v. infusion over 60 minutes until disease progression or unacceptable toxicity occurs. An anti-TIM3 antibody can be administered with pembrolizumab (KEYTRUDA®) every 3 weeks as an i.v. infusion over 30 minutes until disease progression or unacceptable toxicity occurs. An anti-TIM3 antibody can be administered with atezolizumab (TECENTRIQ™) every 3 weeks as an i.v. infusion over 60 or 30 minutes until disease progression or unacceptable toxicity occurs.

An antibody can be administered as a sustained release formulation, in which case less frequent administration is required. Dosage and frequency vary depending on the half-life of the antibody in the patient. In general, human antibodies show the longest half-life, followed by humanized antibodies, chimeric antibodies, and nonhuman antibodies. The dosage and frequency of administration can vary depending on whether the treatment is prophylactic or therapeutic. In prophylactic applications, a relatively low dosage is administered at relatively infrequent intervals over a long period of time. Some patients continue to receive treatment for the rest of their lives. In therapeutic applications, a relatively high dosage at relatively short intervals is sometimes required until progression of the disease is reduced or terminated, and until the patient shows partial or complete amelioration of symptoms of disease. Thereafter, the patient can be administered a prophylactic regime.

Actual dosage levels of the active ingredients in the pharmaceutical compositions described herein can be varied so as to obtain an amount of the active ingredient which is effective to achieve the desired therapeutic response for a particular patient, composition, and mode of administration, without being toxic to the patient. The selected dosage level will depend upon a variety of pharmacokinetic factors including the activity of the particular compositions described herein employed, or the ester, salt or amide thereof, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts.

A "therapeutically effective dosage" of an anti-TIM3 antibody described herein can result in a decrease in severity of disease symptoms, an increase in frequency and duration of disease symptom-free periods, or a prevention of impairment or disability due to the disease affliction. In the context of cancer, a therapeutically effective dose can result in increased survival, e.g., overall survival, and/or prevention of further deterioration of physical symptoms associated with cancer. Symptoms of cancer are well-known in the art and include, for example, unusual mole features, a change in the appearance of a mole, including asymmetry, border, color and/or diameter, a newly pigmented skin area, an abnormal mole, darkened area under nail, breast lumps, nipple changes, breast cysts, breast pain, death, weight loss, weakness, excessive fatigue, difficulty eating, loss of appetite, chronic cough, worsening breathlessness, coughing up blood, blood in the urine, blood in stool, nausea, vomiting, liver metastases, lung metastases, bone metastases, abdominal fullness, bloating, fluid in peritoneal cavity, vaginal bleeding, constipation, abdominal distension, perforation of colon, acute peritonitis (infection, fever, pain), pain, vomiting blood, heavy sweating, fever, high blood pressure, anemia, diarrhea, jaundice, dizziness, chills, muscle spasms, colon metastases, lung metastases, bladder metastases, liver metastases, bone metastases, kidney metastases, and pancreatic metastases, difficulty swallowing, and the like.

A therapeutically effective dose can prevent or delay onset of cancer, such as can be desired when early or preliminary signs of the disease are present. Laboratory tests utilized in the diagnosis of cancer include chemistries (including the measurement of TIM3 levels), hematology, serology and radiology. Accordingly, any clinical or biochemical assay that monitors any of the foregoing can be used to determine whether a particular treatment is a therapeutically effective dose for treating cancer. One of ordinary skill in the art would be able to determine such amounts based on such factors as the subject's size, the severity of the subject's symptoms, and the particular composition or route of administration selected.

A composition described herein can be administered via one or more routes of administration using one or more of a variety of methods known in the art. As will be appreciated by the skilled artisan, the route and/or mode of administration will vary depending upon the desired results. Routes of administration for the anti-TIM3 antibodies described herein can include intravenous, intramuscular, intradermal, intraperitoneal, subcutaneous, spinal or other parenteral routes of administration, for example by injection or infusion. The phrase "parenteral administration" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Alternatively, an antibody described herein could potentially be administered via a non-parenteral route, such as a topical, epidermal or mucosal route of administration, for example, intranasally, orally, vaginally, rectally, sublingually or topically.

The active compounds can be prepared with carriers that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., Sustained and Controlled Release Drug Delivery Systems, J. R. Robinson, ed., Marcel Dekker, Inc., New York, 1978.

Therapeutic compositions can be administered with medical devices known in the art. For example, in some embodiments, a therapeutic composition described herein can be administered with a needleless hypodermic injection device, such as the devices disclosed in U.S. Pat. Nos. 5,399,163; 5,383,851; 5,312,335; 5,064,413; 4,941,880; 4,790,824; or 4,596,556. Examples of well-known implants and modules for use with anti-TIM3 antibodies described herein include: U.S. Pat. No. 4,487,603, which discloses an implantable micro-infusion pump for dispensing medication at a controlled rate; U.S. Pat. No. 4,486,194, which discloses a therapeutic device for administering medicaments through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multi-chamber compartments; and U.S. Pat. No. 4,475,196, which discloses an osmotic drug delivery system. These patents are incorporated herein by reference. Many other such implants, delivery systems, and modules are known to those skilled in the art.

In some embodiments, the anti-TIM3 antibodies described herein can be formulated to ensure proper distribution in vivo. For example, the blood-brain barrier (BBB) excludes many highly hydrophilic compounds. To ensure that the therapeutic compounds described herein cross the BBB (if desired, e.g., for brain cancers), they can be formulated, for example, in liposomes. For methods of manufacturing liposomes, see, e.g., U.S. Pat. Nos. 4,522, 811; 5,374,548; and 5,399,331. The liposomes can comprise one or more moieties which are selectively transported into specific cells or organs, thus enhance targeted drug delivery (see, e.g., V. V. Ranade (1989) *J. Clin. Pharmacol.* 29:685). Exemplary targeting moieties include folate or biotin (see, e.g., U.S. Pat. No. 5,416,016 to Low et al.); mannosides (Umezawa et al., (1988) *Biochem. Biophys. Res. Commun.* 153: 1038); antibodies (P. G. Bloeman et al. (1995) *FEBS Lett.* 357: 140; M. Owais et al. (1995) *Antimicrob. Agents Chemother.* 39: 180); surfactant protein A receptor (Briscoe et al. (1995) *Am. J. Physiol.* 1233: 134); p 120 (Schreier et al. (1994) *J. Biol. Chem.* 269:9090); see also K. Keinanen; M. L. Laukkanen (1994) *FEBS Lett.* 346: 123; J. J. Killion; I. J. Fidler (1994) *Immunomethods* 4:273.

XVI. Uses and Methods

The antibodies, antibody compositions and methods described herein have numerous in vitro and in vivo utilities involving, for example, enhancement of immune response, such as by inhibiting (or antagonizing) TIM3 (e.g., signaling), or detection of TIM3. In some embodiments, the anti-TIM3 antibodies described herein are human antibodies. For example, anti-TIM3 antibodies described herein can be administered to cells in culture, in vitro or ex vivo, or to human subjects, e.g., in vivo, to enhance immunity in a variety of diseases. Accordingly, provided herein are methods of modifying an immune response in a subject comprising administering to the subject an anti-TIM3 antibody, or antigen binding portion thereof, described herein such that the immune response in the subject is modified. In some embodiments, the response is enhanced, stimulated or up-regulated.

Subjects suitable for the present methods include human patients in whom enhancement of an immune response would be desirable. The methods are particularly suitable for treating human patients having a disorder that can be treated by augmenting an immune response (e.g., a T-cell mediated immune response, e.g., an antigen specific T cell response). In some embodiments, the methods are particularly suitable for treatment of cancer in vivo. To achieve antigen-specific enhancement of immunity, anti-TIM3 antibodies described herein can be administered together with an antigen of interest or the antigen can already be present in the subject to be treated (e.g., a tumor-bearing or virus-bearing subject). When antibodies to TIM3 are administered together with another agent, the two can be administered separately or simultaneously.

Also encompassed are methods for detecting the presence of human TIM3 antigen in a sample, or measuring the amount of human TIM3 antigen, comprising contacting the sample, and a control sample, with a monoclonal antibody, e.g., a human monoclonal antibody, or an antigen binding portion thereof, which specifically binds to human TIM3, under conditions that allow for formation of a complex between the antibody or portion thereof and human TIM3. The formation of a complex is then detected, wherein a difference complex formation between the sample compared to the control sample is indicative the presence of human TIM3 antigen in the sample. Moreover, the anti-TIM3 antibodies described herein can be used to purify human TIM3 via immunoaffinity purification.

Given the ability of anti-TIM3 antibodies described herein to stimulate or co-stimulate T cell responses, e.g., antigen-specific T cell responses, such as by inhibiting negative effects of TIM3, provided herein are in vitro and in vivo methods of using the anti-TIM3 antibodies described herein to stimulate, enhance or upregulate antigen-specific T cell responses, e.g., anti-tumor T cell responses. In some embodiments, CD3 stimulation is also provided (e.g., by coincubation with a cell expressing membrane CD3), which stimulation can be provided at the same time, before, or after stimulation with an anti-TIM3 antibody. For example, provided herein are methods of stimulating an antigen-specific T cell response comprising contacting said T cell with an anti-TIM3 antibody described herein, and optionally with an anti-CD3 antibody, such that an antigen-specific T cell response is stimulated.

Any suitable indicator of an antigen-specific T cell response can be used to measure the antigen-specific T cell response. Non-limiting examples of such suitable indicators include increased T cell proliferation in the presence of the antibody and/or increase cytokine production in the presence of the antibody. In some embodiments, interleukin-2 and/or interferon-γ production by the antigen-specific T cell is stimulated.

T cells that can be enhanced or co-stimulated with anti-TIM3 antibodies include CD4⁺ T cells and CD8⁺ T cells. The T cells can be Teff cells, e.g., CD4⁺ Teff cells, CD8⁺ Teff cells, Thelper (Th) cells (e.g., Th1 cells) or T cytotoxic (Tc) cells.

Further encompassed are methods of stimulating an immune response (e.g., an antigen-specific T cell response) in a subject comprising administering an anti-TIM3 antibody described herein to the subject such that an immune response (e.g., an antigen-specific T cell response) in the subject is stimulated. In some embodiments, the subject is a tumor-bearing subject and an immune response against the tumor is stimulated. A tumor can be a solid tumor or a liquid tumor, e.g., a hematological malignancy. In some embodiments, a tumor is an immunogenic tumor. In some embodiments, a tumor is non-immunogenic. In some embodiments, a tumor is PD-L1 positive. In some embodiments a tumor is PD-L1 negative. A subject can also be a virus-bearing subject and an immune response against the virus is stimulated.

Further provided are methods for inhibiting growth of tumor cells in a subject comprising administering to the subject an anti-TIM3 antibody described herein such that growth of the tumor is inhibited in the subject. Also provided are methods of treating a viral infection in a subject comprising administering to the subject an anti-TIM3 antibody described herein such that the viral infection is treated in the subject.

In some embodiments, an anti-TIM3 antibody is given to a subject as an adjunctive therapy. Treatments of subjects having cancer with an anti-TIM3 antibody can lead to prolonged survival, e.g., long-term durable response relative to the current standard of care; long term survival of at least 3 months, 6 months, 9 months, 1, 2, 3, 4, 5, 10 or more years, or recurrence-free survival of at least 3 months, 6 months, 9 months, 1, 2, 3, 4, 5, or 10 or more years. In some embodiments, treatment of a subject having cancer with an anti-TIM3 antibody prevents recurrence of cancer or delays recurrence of cancer by, e.g., 3 months, 6 months, 9 months, 1, 2, 3, 4, 5, or 10 or more years. An anti-TIM3 treatment can be used as a first-, second-, or third-line treatment.

Treatment of a subject having cancer with an anti-TIM3 antibody described herein, e.g., TIM3.18.IgG1, can result in, e.g., stable disease, partial response, increased overall survival, increased disease free survival, or enhanced progression free survival.

In some embodiments, an anti-TIM3 antibody described herein is not significantly toxic. For example, a TIM3 antibody is not significantly toxic to an organ of a human, e.g., one or more of the liver, kidney, brain, lungs, and heart, as determined, e.g., in clinical trials. In some embodiments, a TIM3 antibody does not significantly trigger an undesirable immune response, e.g., autoimmunity or inflammation.

In some embodiments, treatment of a subject with an anti-TIM3 antagonist (e.g., an anti-TIM3 antibody described herein) does not result in overstimulation of the immune system to the extent that the subject's immune system then attacks the subject itself (e.g., autoimmune response) or results in, e.g., anaphylaxis. Thus, in some embodiments, anti-TIM3 antibodies do not cause anaphylaxis.

In some embodiments, treatment of a subject with an anti-TIM3 antibody described herein, e.g., an antibody comprising the CDRs or variable regions of 13A3 or a variant thereof (e.g., as described herein) or other anti-TIM3 antibodies described herein, does not cause significant inflammatory reactions, e.g., immune-mediated pneumonitis, immune-mediated colitis, immune mediated hepatitis, immune-mediated nephritis or renal dysfunction, immune-mediated hypophysitis, immune-mediated hypothyroidism and hyperthyroidism, or other immune-mediated adverse reactions. In some embodiments, an anti-TIM3 antibody comprising the CDRs or variable regions of 13A3 or a variant thereof (e.g., as described herein) causes fewer inflammatory reactions, e.g., immune-mediated pneumonitis, immune-mediated colitis, immune mediated hepatitis, immune-mediated nephritis or renal dysfunction, immune-mediated hypophysitis, immune-mediated hypothyroidism and hyperthyroidism, anaphylaxis or other immune-mediated adverse reactions, than other anti-TIM3 antibodies. In some embodiments, treatment of a subject with an anti-TIM3 antibody described herein, e.g., an antibody comprising the CDRs or variable regions of 13A3 or a variant thereof (e.g., as described herein) or other anti-TIM3 antibodies described herein, does not cause significant cardiac disorders, e.g., ventricular arrhythmia; eye disorders, e.g., iridocyclitis; infusion-related reactions; increased amylase; increased lipase; nervous system disorders, e.g., dizziness, peripheral and sensory neuropathy; skin and subcutaneous tissue disorders, e.g., rash, pruritus, exfoliative dermatitis, erythema multiforme, vitiligo or psoriasis; respiratory, thoracic and mediastinal disorders, e.g., cough; fatigue; nausea; decreased appetite; constipation; arthralgia; or diarrhea.

In some embodiments, an anti-TIM3 antibody provides synergistic anti-tumor effects in combination with another cancer therapy, such as a compound that stimulates the immune system (e.g., an immuno-oncology agent), e.g., a compound described herein or a compound modulating a target described herein.

Using human antibodies, as opposed to chimeric or humanized antibodies, may result in a lower levels of anti-drug antibodies (ADA). Accordingly, the human anti-TIM3 antibodies described herein, e.g., TIM3.18.IgG1.3, may have lower ADA relative to anti-TIM3 antibodies that are not human antibodies (e.g., relative to humanized or chimeric anti-TIM3 antibodies).

These and other methods described herein are discussed in further detail below.

XVI.A. Cancer

Inhibition of TIM3 by anti-TIM3 antibodies can enhance the immune response to cancerous cells in a patient having cancer. Provided herein are methods for treating a subject having cancer, comprising administering to the subject an anti-TIM3 antibody described herein, such that the subject is treated, e.g., such that growth of cancerous tumors is inhibited or reduced and/or that the tumors regress and/or that prolonged survival is achieved. An anti-TIM3 antibody can be used alone to inhibit the growth of cancerous tumors. Alternatively, an anti-TIM3 antibody can be used in conjunction with another agent, e.g., another immunogenic agent, a standard cancer treatment, or another antibody, as described below.

Accordingly, provided herein are methods of treating cancer, e.g., by inhibiting growth of tumor cells, in a subject, comprising administering to the subject a therapeutically effective amount of an anti-TIM3 antibody described herein, e.g., TIM3.2, TIM3.4, TIM3.5, TIM3.6, 9F6, 8B9, TIM3.9, TIM3.10, TIM3.11, TIM3.12, TIM3.13, TIM3.14, TIM3.15, TIM3.16, TIM3.17, TIM3.18, TIM3.7, TIM3.8, TIM3.24, 23B3, and TIM3.25 having a wildtype IgG constant region or a constant region having reduced effector function, e.g., IgG1.1 or IgG1.3, or antigen binding portion thereof. The antibody can be a human anti-TIM3 antibody (such as any of the human anti-human TIM3 antibodies described herein). Cancers whose growth can be inhibited using the antibodies of the disclosure include cancers typically responsive to immunotherapy and those that are not typically responsive to immunotherapy. Cancers that can be treated also include TIM3 positive cancers. Cancers can be cancers with solid tumors or blood malignancies (liquid tumors). Non-limiting examples of cancers for treatment include squamous cell carcinoma, small-cell lung cancer, non-small cell lung cancer, squamous non-small cell lung cancer (NSCLC), nonsquamous NSCLC, glioma, gastrointestinal cancer, renal cancer (e.g., clear cell carcinoma), ovarian cancer, liver cancer, colorectal cancer, endometrial cancer, kidney cancer (e.g., renal cell carcinoma (RCC)), prostate cancer (e.g., hormone refractory prostate adenocarcinoma), thyroid cancer, neuroblastoma, pancreatic cancer, glioblastoma (glioblastoma multiforme), cervical cancer, stomach cancer, bladder cancer, hepatoma, breast cancer, colon carcinoma, and head and neck cancer (or carcinoma), gastric cancer, germ cell tumor, pediatric sarcoma, sinonasal natural killer, melanoma (e.g., metastatic malignant melanoma, such as cutaneous or intraocular malignant melanoma), bone cancer, skin cancer, uterine cancer, cancer of the anal region, testicular cancer, carcinoma of the fallopian tubes, carcinoma of the endometrium, carcinoma of the cervix, carcinoma of the vagina, carcinoma of the vulva, cancer of the esophagus, cancer of the small intestine, cancer of the endocrine system, cancer of the parathyroid gland, cancer of the adrenal gland, sarcoma of soft tissue, cancer of the urethra, cancer of the penis, solid tumors of childhood, cancer of the ureter, carcinoma of the renal pelvis, neoplasm of the central nervous system (CNS), primary CNS lymphoma, tumor angiogenesis, spinal axis tumor, brain cancer, brain stem glioma, pituitary adenoma, Kaposi's sarcoma, epidermoid cancer, squamous cell cancer, T-cell lymphoma, environmentally-induced cancers including those induced by asbestos, virus-related cancers or cancers of viral origin (e.g., human papilloma virus (HPV-related or -originating tumors)), and hematologic malignancies derived from either of the two major blood cell lineages, i.e., the myeloid cell line (which produces granulocytes, erythrocytes, thrombocytes, macrophages and mast cells) or lymphoid cell line (which produces B, T, NK and plasma cells), such as all types of leukemias, lymphomas, and myelomas, e.g., acute, chronic, lymphocytic and/or myelogenous leukemias, such as acute leukemia (ALL), acute myelogenous leukemia (AML), chronic lymphocytic leukemia (CLL), and chronic myelogenous leukemia (CML), undifferentiated AML (MO), myeloblastic leukemia (M1), myeloblastic leukemia (M2; with cell maturation), promyelocytic leukemia (M3 or M3 variant [M3V]), myelomonocytic leukemia (M4 or M4 variant with eosinophilia [M4E]), monocytic leukemia (M5), erythroleukemia (M6), megakaryoblastic leukemia (M7), isolated granulocytic sarcoma, and chloroma; lymphomas, such as Hodgkin's lymphoma (HL), non-Hodgkin's lymphoma (NHL), B cell hematologic malignancy, e.g., B-cell lymphomas, T-cell lymphomas, lymphoplasmacytoid lymphoma, monocytoid B-cell lymphoma, mucosa-associated lymphoid tissue (MALT) lymphoma, anaplastic (e.g., Ki 1+) large-cell lymphoma, adult T-cell lymphoma/leukemia, mantle cell lymphoma, angio immunoblastic T-cell lymphoma, angiocentric lymphoma, intestinal T-cell lymphoma, primary mediastinal B-cell lymphoma, precursor T-lymphoblastic lymphoma, T-lymphoblastic; and lymphoma/leukaemia (T-Lbly/T-ALL), peripheral T-cell lymphoma, lymphoblastic lymphoma, post-transplantation lymphoproliferative disorder, true histiocytic lymphoma, primary central nervous system lymphoma, primary effusion lymphoma, B cell lymphoma, lymphoblastic lymphoma (LBL), hematopoietic tumors of lymphoid lineage, acute lymphoblastic leukemia, diffuse large B-cell lymphoma, Burkitt's lymphoma, follicular lymphoma, diffuse histiocytic lymphoma (DHL), immunoblastic large cell lymphoma, precursor B-lymphoblastic lymphoma, cutaneous T-cell lymphoma (CTLC) (also called mycosis fungoides or Sezary syndrome), and lymphoplasmacytoid lymphoma (LPL) with Waldenstrom's macroglobulinemia; myelomas, such as IgG myeloma, light chain myeloma, nonsecretory myeloma, smoldering myeloma (also called indolent myeloma), solitary plasmocytoma, and multiple myelomas, chronic lymphocytic leukemia (CLL), hairy cell lymphoma; hematopoietic tumors of myeloid lineage, tumors of mesenchymal origin, including fibrosarcoma and rhabdomyoscarcoma; seminoma, teratocarcinoma, tumors of the central and peripheral nervous, including astrocytoma, schwannomas; tumors of mesenchymal origin, including fibrosarcoma, rhabdomyoscaroma, and osteosarcoma; and other tumors, including melanoma, xeroderma pigmentosum, keratoacanthoma, seminoma, thyroid follicular cancer and teratocarcinoma, hematopoietic tumors of lymphoid lineage, for example T-cell and B-cell tumors, including but not limited to T-cell disorders such as T-prolymphocytic leukemia (T-PLL), including of the small cell and cerebriform cell type; large granular lymphocyte leukemia (LGL) of the T-cell type; a/d T-NHL hepatosplenic lymphoma; peripheral/post-thymic T cell lymphoma (pleomorphic and immunoblastic subtypes); angiocentric (nasal) T-cell lymphoma; cancer of the head or neck, renal cancer, rectal cancer, cancer of the thyroid gland; acute myeloid lymphoma, as well as any combinations of said cancers. The methods described herein can also be used for treatment of metastatic cancers, unresectable, refractory cancers (e.g., cancers refractory to previous immunotherapy, e.g., with a blocking CTLA-4 or PD-1 antibody), and/or recurrent cancers.

In some embodiments, an anti-TIM3 antibody is administered to patients having a cancer that exhibited an inadequate response to, or progressed on, a prior treatment, e.g., a prior treatment with an immuno-oncology or immunotherapy drug, or patients having a cancer that is refractory or resistant, either intrinsically refractory or resistant (e.g., refractory to a PD-1 pathway antagonist), or a wherein the resistance or refractory state is acquired. For example, subjects who are not responsive or not sufficiently responsive to a first therapy or who see disease progression following treatment, e.g., anti-PD-1 treatment, can be treated by administration of an anti-TIM3 antibody alone or in combination with another therapy (e.g., with an anti-PD-1 therapy).

In some embodiments, an anti-TIM3 antibody is administered to patients who have not previously received (i.e., been treated with) an immuno-oncology agent, e.g., a PD-1 pathway antagonist.

In some embodiments, a method of treating cancer in a subject comprises first determining whether the subject is TIM3 positive, e.g., has tumor cells or TILs that express TIM3, and if the subject has TIM3 positive cancer or TIL cells, then administering to the subject an anti-TIM3 antibody, e.g., described herein. A method of treating a subject having cancer with an anti-TIM3 antibody may comprise administering to a subject who has cancer cells or TIL cells that express TIM3, a therapeutically effective amount of a TIM3 antibody. Also provided herein are methods for predicting whether a subject will respond to treatment with an anti-TIM3 antibody, wherein the methods comprise determining the level of TIM3 in cancer or TIL cells of the patient, and if cancer or TIL cells of the subject are TIM3 positive, then the subject is likely to respond to a treatment with a TIM3 antibody.

In some embodiments, a method of treating cancer in a subject comprises first determining whether the subject is PD-L1 or PD-1 positive, e.g., has tumor cells or TILs that express PD-L1 or PD-1, and if the subject has PD-L1 or PD-1 positive cancer or TIL cells, then administering to the subject an anti-TIM3 antibody (and optionally a PD-1 or PD-L1 antagonist), e.g., described herein. A method of treating a subject having cancer with an anti-TIM3 antibody (and optionally a PD-1 or PD-L1 antagonist) may comprise administering to a subject who has cancer cells or TIL cells that express PD-L1 or PD-1, a therapeutically effective amount of a TIM3 antibody (and optionally a PD-1 or PD-L1 antagonist). Also provided herein are methods for predicting whether a subject will respond to treatment with an anti-TIM3 antibody (and optionally a PD-1 or PD-L1 antagonist), wherein the methods comprise determining the level of PD-L1 or PD-1 in cancer or TIL cells of the patient, and if cancer or TIL cells of the subject are PD-L1 or PD-1 positive, then the subject is likely to respond to a treatment with a TIM3 antibody (and optionally a PD-1 or PD-L1 antagonist).

An anti-TIM3 antibody can be administered with a standard of care treatment. An anti-TIM3 antibody can be administered as a maintenance therapy, e.g., a therapy that is intended to prevent the occurrence or recurrence of tumors.

An anti-TIM3 antibody can be administered with another treatment, e.g., radiation, surgery, or chemotherapy. For example e, anti-TIM3 antibody adjunctive therapy can be administered when there is a risk that micrometastases can be present and/or in order to reduce the risk of a relapse.

An anti-TIM3 antibody can be administered as a monotherapy, or as the only immuno stimulating therapy. Antibodies to TIM3, e.g., the anti-TIM3, can also be combined with an immunogenic agent, such as cancerous cells, purified tumor antigens (including recombinant proteins, peptides, and carbohydrate molecules), cells, and cells transfected with genes encoding immune stimulating cytokines (He et al, (2004) *J. Immunol.* 173:4919-28). Non-limiting examples of tumor vaccines that can be used include peptides of melanoma antigens, such as peptides of gp100, MAGE antigens, Trp-2, MARTI and/or tyrosinase, or tumor cells transfected to express the cytokine GM-CSF (discussed further below).

In humans, some tumors have been shown to be immunogenic such as melanomas. By lowering the threshold of T cell activation via TIM3 inhibition, the tumor responses in the host can be activated, allowing treatment of non-immunogenic tumors or those having limited immunogenicity.

An anti-TIM3 antibody, e.g., an anti-TIM3 antibody described herein, can be combined with a vaccination protocol. Many experimental strategies for vaccination against tumors have been devised (see Rosenberg, S., 2000, Development of Cancer Vaccines, ASCO Educational Book Spring: 60-62; Logothetis, C, 2000, ASCO Educational Book Spring: 300-302; Khayat, D. 2000, ASCO Educational Book Spring: 414-428; Foon, K. 2000, ASCO Educational Book Spring: 730-738; see also Restifo, N. and Sznol, M., Cancer Vaccines, Ch. 61, pp. 3023-3043 in DeVita et al. (eds.), 1997, Cancer: Principles and Practice of Oncology, Fifth Edition). In one of these strategies, a vaccine is prepared using autologous or allogeneic tumor cells. These cellular vaccines have been shown to be most effective when the tumor cells are transduced to express GM-CSF. GM-CSF has been shown to be a potent activator of antigen presentation for tumor vaccination (Dranoff et al. (1993) *Proc. Natl. Acad. Sci USA.* 90: 3539-43).

The study of gene expression and large scale gene expression patterns in various tumors has led to the definition of so called tumor specific antigens (Rosenberg, S A (1999) *Immunity* 10: 281-7). In many cases, these tumor specific antigens are differentiation antigens expressed in the tumors and in the cell from which the tumor arose, for example melanocyte antigens gp100, MAGE antigens, and Trp-2. More importantly, many of these antigens can be shown to be the targets of tumor specific T cells found in the host. TIM3 inhibition can be used in conjunction with a collection of recombinant proteins and/or peptides expressed in a tumor in order to generate an immune response to these proteins. These proteins are normally viewed by the immune system as self-antigens and are therefore tolerant to them. The tumor antigen can include the protein telomerase, which is required for the synthesis of telomeres of chromosomes and which is expressed in more than 85% of human cancers and in only a limited number of somatic tissues (Kim et al. (1994) *Science* 266: 2011-2013). Tumor antigen can also be "neo-antigens" expressed in cancer cells because of somatic mutations that alter protein sequence or create fusion proteins between two unrelated sequences (i.e., bcr-abl in the Philadelphia chromosome), or idiotype from B cell tumors.

Other tumor vaccines can include the proteins from viruses implicated in human cancers such a Human Papilloma Viruses (HPV), Hepatitis Viruses (HBV and HCV) and Kaposi's Herpes Sarcoma Virus (KHSV). Another form of tumor specific antigen which can be used in conjunction with TIM3 inhibition is purified heat shock proteins (HSP) isolated from the tumor tissue itself. These heat shock proteins contain fragments of proteins from the tumor cells and these HSPs are highly efficient at delivery to antigen presenting cells for eliciting tumor immunity (Suot & Srivastava (1995) *Science* 269: 1585-1588; Tamura et al. (1997) *Science* 278: 117-120).

Dendritic cells (DC) are potent antigen presenting cells that can be used to prime antigen-specific responses. DCs can be produced ex vivo and loaded with various protein and peptide antigens as well as tumor cell extracts (Nestle et al. (1998) *Nature Medicine* 4: 328-332). DCs can also be transduced by genetic means to express these tumor antigens as well. DCs have also been fused directly to tumor cells for the purposes of immunization (Kugler et al. (2000) *Nature Medicine* 6:332-336). As a method of vaccination, DC immunization can be effectively combined with TIM3 inhibition to activate more potent anti-tumor responses.

TIM3 inhibition can also be combined with standard cancer treatments (e.g., surgery, radiation, and chemotherapy). TIM3 inhibition can be effectively combined with chemotherapeutic regimes. In these instances, it can be possible to reduce the dose of chemotherapeutic reagent administered (Mokyr et al. (1998) *Cancer Research* 58: 5301-5304). An example of such a combination is an anti-TIM3 antibody in combination with decarbazine for the treatment of melanoma. Another example of such a combination is an anti-TIM3 antibody in combination with interleukin-2 (IL-2) for the treatment of melanoma. The scientific rationale behind the combined use of TIM3 inhibition and chemotherapy is that cell death, that is a consequence of the cytotoxic action of most chemotherapeutic compounds, should result in increased levels of tumor antigen in the antigen presentation pathway. Other combination therapies that can result in synergy with TIM3 inhibition through cell death are radiation, surgery, and hormone deprivation. Each of these protocols creates a source of tumor antigen in the host. Angiogenesis inhibitors can also be combined with TIM3 inhibition. Inhibition of angiogenesis leads to tumor cell death which can feed tumor antigen into host antigen presentation pathways.

The anti-TIM3 antibodies described herein can also be used in combination with bispecific antibodies that target Fcα or Fcγ receptor-expressing effectors cells to tumor cells (see, e.g., U.S. Pat. Nos. 5,922,845 and 5,837,243). Bispecific antibodies can be used to target two separate antigens. For example anti-Fc receptor/anti-tumor antigen (e.g., Her-2/neu) bispecific antibodies have been used to target macrophages to sites of tumor. This targeting can more effectively activate tumor specific responses. The T cell arm of these responses would be augmented by the inhibition of TIM3. Alternatively, antigen can be delivered directly to DCs by the use of bispecific antibodies which bind to tumor antigen and a dendritic cell specific cell surface marker.

Tumors evade host immune surveillance by a large variety of mechanisms. Many of these mechanisms can be overcome by the inactivation of proteins which are expressed by the tumors and which are immunosuppressive. These include among others TGF-β (Kehrl et al. (1986) *J. Exp. Med.* 163: 1037-1050), IL-10 (Howard & O'Garra (1992) *Immunology Today* 13: 198-200), and Fas ligand (Hahne et al. (1996) *Science* 274: 1363-1365). Antibodies to each of these entities can be used in combination with anti-TIM3 antibodies to counteract the effects of the immunosuppressive agent and favor tumor immune responses by the host.

Other antibodies which activate host immune responsiveness can be used in combination with anti-TIM3 antibodies. These include molecules on the surface of dendritic cells which activate DC function and antigen presentation. Anti-CD40 antibodies are able to substitute effectively for T cell helper activity (Ridge et al. (1998) *Nature* 393: 474-478) and can be used in conjunction with anti-TIM3 antibodies. Activating antibodies to T cell costimulatory molecules such as CTLA-4 (e.g., U.S. Pat. No. 5,811,097), OX-40 (Weinberg et al. (2000) *Immunol* 164: 2160-2169), 4-1BB (Melero et al. (1997) *Nature Medicine* 3: 682-685 (1997), and ICOS (Hutloff et al. (1999) *Nature* 397: 262-266) can also provide for increased levels of T cell activation. Inhibitors of PD1 or PD-L1 can also be used in conjunction with an anti-TIM3 antibody. Other combination are provided elsewhere herein.

Bone marrow transplantation is currently being used to treat a variety of tumors of hematopoietic origin. While graft versus host disease is a consequence of this treatment, therapeutic benefit can be obtained from graft vs. tumor responses. TIM3 inhibition can be used to increase the effectiveness of the donor engrafted tumor specific T cells.

There are also several experimental treatment protocols that involve ex vivo activation and expansion of antigen specific T cells and adoptive transfer of these cells into recipients in order to stimulate antigen-specific T cells against tumor (Greenberg & Riddell (1999) *Science* 285: 546-51). These methods can also be used to activate T cell responses to infectious agents such as CMV. Ex vivo activation in the presence of anti-TIM3 antibodies can increase the frequency and activity of the adoptively transferred T cells.

XVI.B. Infectious Diseases

Methods described herein can also be used to treat patients that have been exposed to particular toxins or pathogens. Accordingly, another aspect described herein provides a method of treating an infectious disease in a subject comprising administering to the subject an anti-TIM3 antibody, or antigen binding portion thereof, such that the subject is treated for the infectious disease. Additionally or alternatively, the antibody can be a chimeric or humanized antibody.

Similar to its application to tumors as discussed above, antibody-mediated TIM3 inhibition can be used alone, or as an adjuvant, in combination with vaccines, to stimulate the immune response to pathogens, toxins, and self-antigens. Examples of pathogens for which this therapeutic approach can be particularly useful, include pathogens for which there is currently no effective vaccine, or pathogens for which conventional vaccines are less than completely effective. These include, but are not limited to HIV, Hepatitis (A, B, & C), Influenza, Herpes, Giardia, Malaria, Leishmania, Staphylococcus aureus, Pseudomonas aemginosa. TIM3 inhibition can be useful against established infections by agents such as HIV that present altered antigens over the course of the infections. These novel epitopes are recognized as foreign at the time of anti-human TIM3 antibody administration, thus provoking a strong T cell response.

Some examples of pathogenic viruses causing infections treatable by methods described herein include HIV, hepatitis (A, B, or C), herpes virus (e.g., VZV, HSV-1, HAV-6, HSV-II, and CMV, Epstein Barr virus), adenovirus, influenza virus, flaviviruses, echovirus, rhinovirus, coxsackie virus, coronavirus, respiratory syncytial virus, mumps virus, rotavirus, measles virus, rubella virus, parvovirus, vaccinia virus, HTLV virus, dengue virus, papillomavirus, molluscum virus, poliovirus, rabies virus, JC virus and arboviral encephalitis virus.

Some examples of pathogenic bacteria causing infections treatable by methods described herein include chlamydia, rickettsial bacteria, mycobacteria, staphylococci, streptococci, pneumonococci, meningococci and gonococci, klebsiella, proteus, serratia, pseudomonas, legionella, diphtheria, salmonella, bacilli, cholera, tetanus, botulism, anthrax, plague, leptospirosis, and Lymes disease bacteria.

Some examples of pathogenic fungi causing infections treatable by methods described herein include *Candida* (albicans, kmsei, glabrata, tropicalis, etc.), *Cryptococcus neoformans, Aspergillus* (fumigatus, niger, etc.), Genus *Mucorales* (mucor, absidia, rhizopus), *Sporothrix schenkii, Blastomyces dermatitidis, Paracoccidioides brasiliensis, Coccidioides immitis* and *Histoplasma capsulatum*.

Some examples of pathogenic parasites causing infections treatable by methods described herein include *Entamoeba histolytica, Balantidium coil, Naegleriafowleri, Acanthamoeba* sp., *Giardia lambia, Cryptosporidium* sp., *Pneumocystis carinhi, Plasmodium vivax, Babesia microti, Trypanosoma brucei, Trypanosoma cruzi, Leishmania donovani, Toxoplasma gondii*, and *Nippostrongylus brasiliensis*.

In all of the above methods, TIM3 inhibition can be combined with other forms of immunotherapy, e.g., those described herein, such as cytokine treatment (e.g., interferons, GM-CSF, G-CSF, IL-2), or bispecific antibody therapy, which provides for enhanced presentation of tumor antigens (see, e.g., Holliger (1993) *Proc. Natl. Acad. Sci. USA* 90:6444-6448; Poljak (1994) *Structure* 2: 1121-1123).

XVI.C. Autoimmune Reactions

Anti-TIM3 antibodies could provoke and amplify autoimmune responses. Indeed, induction of anti-tumor responses using tumor cell and peptide vaccines reveals that many antitumor responses involve anti-self reactivities (van Elsas et al. (2001) *J. Exp. Med.* 194:481-489; Overwijk, et al. (1999) *Proc. Natl. Acad. Sci. U.S.A.* 96: 2982-2987; Hurwitz, (2000) supra; Rosenberg & White (1996) *J. Immu-* nother Emphasis Tumor Immunol 19 (1): 81-4). Therefore, it is possible to consider using anti-TIM3 antibodies in conjunction with various self-proteins in order to devise vaccination protocols to efficiently generate immune responses against these self-proteins for disease treatment. For example, Alzheimer's disease involves inappropriate accumulation of Aβ peptide in amyloid deposits in the brain; antibody responses against amyloid are able to clear these amyloid deposits (Schenk et al., (1999) Nature 400: 173-177).

Other self-proteins can also be used as targets such as IgE for the treatment of allergy and asthma, and TNF-α for rheumatoid arthritis. Finally, antibody responses to various hormones can be induced by the use of anti-TIM3 antibodies. Neutralizing antibody responses to reproductive hormones can be used for contraception. Neutralizing antibody response to hormones and other soluble factors that are required for the growth of particular tumors can also be considered as possible vaccination targets.

Analogous methods as described above for the use of anti-TIM3 antibodies can be used for induction of therapeutic autoimmune responses to treat patients having an inappropriate accumulation of other self-antigens, such as amyloid deposits, including Aβ in Alzheimer's disease, cytokines such as TNF-α, and IgE.

XVI.D. Vaccines

Anti-TIM3 antibodies described herein can be used to stimulate antigen-specific immune responses by co-administration of an anti-TIM3 antibody with an antigen of interest (e.g., a vaccine). Accordingly, provided herein are methods of enhancing an immune response to an antigen in a subject, comprising administering to the subject: (i) the antigen; and (ii) an anti-TIM3 antibody, or antigen binding portion thereof, such that an immune response to the antigen in the subject is enhanced. The antibody can be a human anti-human TIM3 antibody (such as any of the human anti-TIM3 antibodies described herein). Additionally or alternatively, the antibody can be a chimeric or humanized antibody. The antigen can be, for example, a tumor antigen, a viral antigen, a bacterial antigen or an antigen from a pathogen. Non-limiting examples of such antigens include those discussed in the sections above, such as the tumor antigens (or tumor vaccines) discussed above, or antigens from the viruses, bacteria or other pathogens described above.

In some embodiments, a peptide or fusion protein comprising the epitope to which an anti-TIM3 antibody binds is used as a vaccine instead of, or in addition to, an anti-TIM3 antibody.

Suitable routes of administering the antibody compositions (e.g., human monoclonal antibodies, multispecific and bispecific molecules and immunoconjugates) described herein in vivo and in vitro are well known in the art and can be selected by those of ordinary skill. For example, the antibody compositions can be administered by injection (e.g., intravenous or subcutaneous). Suitable dosages of the molecules used will depend on the age and weight of the subject and the concentration and/or formulation of the antibody composition.

As previously described, anti-TIM3 antibodies described herein can be co-administered with one or other more therapeutic agents, e.g., a cytotoxic agent, a radiotoxic agent or an immunosuppressive agent. The antibody can be linked to the agent (as an immuno-complex) or can be administered separate from the agent. In the latter case (separate administration), the antibody can be administered before, after or concurrently with the agent or can be coadministered with other known therapies, e.g., an anti-cancer therapy, e.g., radiation. Such therapeutic agents include, among others, anti-neoplastic agents such as doxorubicin (adriamycin), cisplatin bleomycin sulfate, carmustine, chlorambucil, dacarbazine and cyclophosphamide hydroxyurea which, by themselves, are only effective at levels which are toxic or subtoxic to a patient. Cisplatin is intravenously administered as a 100 mg/ml dose once every four weeks and adriamycin is intravenously administered as a 60-75 mg/ml dose once every 21 days. Co-administration of anti-TIM3 antibodies, or antigen binding fragments thereof, described herein with chemotherapeutic agents provides two anti-cancer agents which operate via different mechanisms which yield a cytotoxic effect to human tumor cells. Such coadministration can solve problems due to development of resistance to drugs or a change in the antigenicity of the tumor cells which would render them unreactive with the antibody.

Also within the scope described herein are kits comprising the antibody compositions described herein (e.g., human antibodies, bispecific or multispecific molecules, or immunoconjugates) and instructions for use. The kit can further contain at least one additional reagent, or one or more additional human anti-TIM3 antibodies described herein (e.g., a human antibody having a complementary activity which binds to an epitope in TIM3 antigen distinct from the first human antibody). Kits typically include a label indicating the intended use of the contents of the kit. The term label includes any writing, or recorded material supplied on or with the kit, or which otherwise accompanies the kit.

XVI.E. Combination Therapies

In addition to the combinations therapies provided above, anti-TIM3 antibodies, e.g., those described herein, can also be used in combination therapy, e.g., for treating cancer, as described below.

Provided herein are methods of combination therapy in which an anti-TIM3 antibody is coadministered with one or more additional agents, e.g., small molecule drugs, antibodies, or antigen binding portions thereof, that are effective in stimulating immune responses to thereby further enhance, stimulate or upregulate immune responses in a subject.

Generally, an anti-TIM3 antibody, e.g., described herein, can be combined with (i) an agonist of a stimulatory (e.g., co-stimulatory) molecule (e.g., receptor or ligand) and/or (ii) an antagonist of an inhibitory signal or molecule (e.g., receptor or ligand) on immune cells, such as T cells, both of which result in amplifying immune responses, such as antigen-specific T cell responses. In some aspects, an immuno-oncology agent is (i) an agonist of a stimulatory (including a co-stimulatory) molecule (e.g., receptor or ligand) or (ii) an antagonist of an inhibitory (including a co-inhibitory) molecule (e.g., receptor or ligand) on cells, e.g., those inhibiting T cell activation or those involved in innate immunity, e.g., NK cells, and wherein the immuno-oncology agent enhances innate immunity. Such immuno-oncology agents are often referred to as immune checkpoint regulators, e.g., immune checkpoint inhibitor or immune checkpoint stimulator.

In some embodiments, an anti-TIM3 antibody is administered with an agent that targets a stimulatory or inhibitory molecule that is a member of the immunoglobulin super family (IgSF). For example, anti-TIM3 antibodies, e.g., described herein, can be administered to a subject with an agent that targets a member of the IgSF family to increase an immune response. For example, an anti-TIM3 antibody can be administered with an agent that targets (or binds specifically to) a member of the B7 family of membrane-bound ligands that includes B7-1, B7-2, B7-H1 (PD-L1), B7-DC (PD-L2), B7-H2 (ICOS-L), B7-H3, B7-H4, B7-H5

(VISTA), and B7-H6 or a co-stimulatory or co-inhibitory receptor or ligand binding specifically to a B7 family member.

An anti-TIM3 antibody can also be administered with an agent that targets a member of the TNF and TNFR family of molecules (ligands or receptors), such as CD40 and CD40L, OX-40, OX-40L, CD70, CD27L, CD30, CD30L, 4-1BBL, CD137, TRAIL/Apo2-L, TRAILR1/DR4, TRAILR2/DR5, TRAILR3, TRAILR4, OPG, RANK, RANKL, TWEAKR/Fn 14, TWEAK, BAFFR, EDAR, XEDAR, TACI, APRIL, BCMA, LTpR, LIGHT, DcR3, HVEM, VEGI/TL1A, TRAMP/DR3, EDA1, EDA2, TNFR1, Lymphotoxin a/TNFp, TNFR2, TNFa, LTpR, Lymphotoxin a 1β2, FAS, FASL, RELT, DR6, TROY, and NGFR (see, e.g., Tansey (2009) *Drug Discovery Today* 00: 1).

T cell responses can be stimulated by a combination of anti-TIM3 antibodies having the variable regions of, e.g., TIM3.2, TIM3.4, TIM3.5, TIM3.6, 9F6, 8B9, TIM3.9, TIM3.10, TIM3.11, TIM3.12, TIM3.13, TIM3.14, TIM3.15, TIM3.16, TIM3.17, TIM3.18, TIM3.7, and TIM3.8, and one or more of the following agents:

(1) An antagonist (inhibitor or blocking agent) of a protein that inhibits T cell activation (e.g., immune checkpoint inhibitors), such as CTLA-4, PD-1, PD-L1, PD-L2, GITR, and LAG-3, Galectin 9, CEACAM-1, BTLA, CD69, Galectin-1, TIGIT, CD113, GPR56, VISTA, B7-H3, B7-H4, 2B4, CD48, GARP, PD1H, LAIR1, TIM-1, and TIM-4; and/or (2) An agonist of a protein that stimulates T cell activation, such as B7-1, B7-2, CD28, 4-1BB (CD137), 4-1BBL, GITR, ICOS, ICOS-L, OX40, OX40L, CD70, CD27, CD40, DR3 and CD28H.

Exemplary agents that modulate one of the above proteins and can be combined with anti-TIM3 antibodies, e.g., those described herein, for treating cancer, include: YERVOY® (ipilimumab) or Tremelimumab (to CTLA-4), galiximab (to B7.1), BMS-936558 (to PD-1), MK-3475 (to PD-1), atezolizumab (TECENTRIQ®), AMP224 (to B7DC), BMS-936559 (to B7-H1), MPDL3280A (to B7-H1), MEDI-570 (to ICOS), AMG557 (to B7H2), MGA271 (to B7H3), IMP321 (to LAG-3), BMS-663513 (to CD137), PF-05082566 (to CD137), CDX-1127 (to CD27), anti-OX40 (Providence Health Services), huMAbOX40L (to OX40L), Atacicept (to TACI), CP-870893 (to CD40), Lucatumumab (to CD40), Dacetuzumab (to CD40), Muromonab-CD3 (to CD3); anti-GITR antibodies MK4166, TRX518, Medi1873, INBRX-110, LK2-145, GWN-323, GITRL-Fc, or any combination thereof.

Other molecules that can be combined with anti-TIM3 antibodies for the treatment of cancer include antagonists of inhibitory receptors on NK cells or agonists of activating receptors on NK cells. For example, anti-TIM3 antibodies can be combined with antagonists of KIR (e.g., lirilumab).

T cell activation is also regulated by soluble cytokines, and anti-TIM3 antibodies can be administered to a subject, e.g., having cancer, with antagonists of cytokines that inhibit T cell activation or agonists of cytokines that stimulate T cell activation.

In some embodiments, anti-TIM3 antibodies can be used in combination with (i) antagonists (or inhibitors or blocking agents) of proteins of the IgSF family or B7 family or the TNF family that inhibit T cell activation or antagonists of cytokines that inhibit T cell activation (e.g., IL-6, IL-10, TGF-β, VEGF; "immunosuppressive cytokines") and/or (ii) agonists of stimulatory receptors of the IgSF family, B7 family or the TNF family or of cytokines that stimulate T cell activation, for stimulating an immune response, e.g., for treating proliferative diseases, such as cancer.

Yet other agents for combination therapies include agents that inhibit or deplete macrophages or monocytes, including but not limited to CSF-1R antagonists such as CSF-1R antagonist antibodies including RG7155 (WO11/70024, WO11/107553, WO11/131407, WO13/87699, WO13/119716, WO13/132044) or FPA-008 (WO11/140249; WO13169264; WO14/036357).

Anti-TIM3 antibodies can also be administered with agents that inhibit TGF-β signaling.

Additional agents that can be combined with an anti-TIM3 antibody include agents that enhance tumor antigen presentation, e.g., dendritic cell vaccines, GM-CSF secreting cellular vaccines, CpG oligonucleotides, and imiquimod, or therapies that enhance the immunogenicity of tumor cells (e.g., anthracyclines).

Yet other therapies that can be combined with an anti-TIM3 antibody include therapies that deplete or block Treg cells, e.g., an agent that specifically binds to CD25.

Another therapy that can be combined with an anti-TIM3 antibody is a therapy that inhibits a metabolic enzyme such as indoleamine dioxigenase (IDO), dioxigenase, arginase, or nitric oxide synthetase.

Another class of agents that can be used with an anti-TIM3 antibody includes agents that inhibit the formation of adenosine, e.g., CD73 inhibitors, or inhibit the adenosine A2A receptor.

Other therapies that can be combined with an anti-TIM3 antibody for treating cancer include therapies that reverse/prevent T cell anergy or exhaustion and therapies that trigger an innate immune activation and/or inflammation at a tumor site.

Other therapies that can be combined with an anti-TIM3 antibody for treating cancer include therapies that block IL-8, e.g., with HuMax-IL8.

An anti-TIM3 antibody can be combined with more than one immuno-oncology agent, and can be, e.g., combined with a combinatorial approach that targets multiple elements of the immune pathway, such as one or more of the following: a therapy that enhances tumor antigen presentation (e.g., dendritic cell vaccine, GM-CSF secreting cellular vaccines, CpG oligonucleotides, imiquimod); a therapy that inhibits negative immune regulation e.g., by inhibiting CTLA-4 and/or PD1/PD-L1/PD-L2 pathway and/or depleting or blocking Tregs or other immune suppressing cells; a therapy that stimulates positive immune regulation, e.g., with agonists that stimulate the CD-137, OX-40, and/or CD40 or GITR pathway and/or stimulate T cell effector function; a therapy that increases systemically the frequency of anti-tumor T cells; a therapy that depletes or inhibits Tregs, such as Tregs in the tumor, e.g., using an antagonist of CD25 (e.g., daclizumab) or by ex vivo anti-CD25 bead depletion; a therapy that impacts the function of suppressor myeloid cells in the tumor, a therapy that enhances immunogenicity of tumor cells (e.g., anthracyclines); adoptive T cell or NK cell transfer including genetically modified cells, e.g., cells modified by chimeric antigen receptors (CAR-T therapy); a therapy that inhibits a metabolic enzyme such as indoleamine dioxigenase (IDO), dioxigenase, arginase, or nitric oxide synthetase; a therapy that reverses/prevents T cell anergy or exhaustion; a therapy that triggers an innate immune activation and/or inflammation at a tumor site; administration of immune stimulatory cytokines; or blocking of immuno repressive cytokines.

Anti-TIM3 antibodies described herein can be used together with one or more of agonistic agents that ligate positive costimulatory receptors, blocking agents that attenuate signaling through inhibitory receptors, antagonists, and one or more agents that increase systemically the frequency of anti-tumor T cells, agents that overcome distinct immune suppressive pathways within the tumor microenvironment (e.g., block inhibitory receptor engagement (e.g., PD-L1/PD-1 interactions), deplete or inhibit Tregs (e.g., using an anti-CD25 monoclonal antibody (e.g., daclizumab) or by ex vivo anti-CD25 bead depletion), inhibit metabolic enzymes such as IDO, or reverse/prevent T cell anergy or exhaustion) and agents that trigger innate immune activation and/or inflammation at tumor sites.

In some embodiments, an anti-TIM3 antibody is administered to a subject together with a BRAF inhibitor if the subject is BRAF V600 mutation positive.

Suitable PD-1 antagonists for use in the combination therapy described herein, include, without limitation, ligands, antibodies (e.g., monoclonal antibodies and bispecific antibodies), and multivalent agents. In some embodiments, the PD-1 antagonist is a fusion protein, e.g., an Fc fusion protein, such as AMP-244. In some embodiments, the PD-1 antagonist is an anti-PD-1 or anti-PD-L1 antibody.

An exemplary anti-PD-1 antibody is nivolumab (BMS-936558) or an antibody that comprises the CDRs or variable regions of one of antibodies 17D8, 2D3, 4H1, 5C4, 7D3, 5F4 and 4A11 described in WO 2006/121168. In some embodiments, an anti-PD-1 antibody is MK-3475 (Lambrolizumab) described in WO2012/145493; AMP-514 described in WO 2012/145493; or PDR001. Further known PD-1 antibodies and other PD-1 inhibitors include those described in WO 2009/014708, WO 03/099196, WO 2009/114335, WO 2011/066389, WO 2011/161699, WO 2012/145493, U.S. Pat. Nos. 7,635,757 and 8,217,149, and U.S. Patent Publication No. 2009/0317368. Any of the anti-PD-1 antibodies disclosed in WO2013/173223 can also be used. An anti-PD-1 antibody that competes for binding with, and/or binds to the same epitope on PD-1 as, as one of these antibodies can also be used in combination treatments.

In some embodiments, the anti-PD-L1 antibody useful for the combination therapy is BMS-936559 (referred to as 12A4 in WO 2007/005874 and U.S. Pat. No. 7,943,743), or an antibody that comprises the CDRs or variable regions of 3G10, 12A4, 10A5, 5F8, 10H10, 1B12, 7H1, 11E6, 12B7 and 13G4, which are described in PCT Publication WO 07/005874 and U.S. Pat. No. 7,943,743. In some embodiments an anti-PD-L1 antibody is MEDI4736 (also known as durvalumab and Anti-B7-H1), MPDL3280A (also known as atezolizumab and RG7446), MSB0010718C (also known as avelumab; WO2013/79174), or rHigM12B7. Any of the anti-PD-L1 antibodies disclosed in WO2013/173223, WO2011/066389, WO2012/145493, U.S. Pat. Nos. 7,635, 757 and 8,217,149 and U.S. Publication No. 2009/145493 can also be used. Anti-PD-L1 antibodies that compete with and/or bind to the same epitope as that of any of these antibodies can also be used in combination treatments.

In some embodiments, the anti-TIM3 antibody of the disclosure can be used with a CTLA-4 antagonist, e.g., an anti-CTLA-4 antibody. In some embodiments, an anti-CTA-4 antibody is an antibody selected from the group of: YERVOY® (ipilimumab or antibody 10D1, described in PCT Publication WO 01/14424), tremelimumab (formerly ticilimumab, CP-675,206), monoclonal or an anti-CTLA-4 antibody described in any of the following publications: WO 98/42752; WO 00/37504; U.S. Pat. No. 6,207,156; Hurwitz et al. (1998) *Pro. Natl. Acad. Sci. USA* 95(17): 10067-10071; Camacho et al. (2004) *J. Clin. Oncology* 22(145): Abstract No. 2505 (antibody CP-675206); and Mokyr et al. (1998) *Cancer Res.* 58:5301-5304. Any of the anti-CTLA-4 antibodies disclosed in WO2013/173223 can also be used.

In some embodiments, an anti-TIM3 antibody of the disclosure is used in combination with a LAG3 antagonist. Examples of anti-LAG3 antibodies include antibodies comprising the CDRs or variable regions of antibodies 25F7, 26H10, 25E3, 8B7, 11F2 or 17E5, which are described in U.S. Patent Publication No. US2011/0150892, WO10/19570 and WO2014008218. In some embodiments, an anti-LAG-3 antibody is BMS-986016. Other art recognized anti-LAG-3 antibodies that can be used include IMP731 and IMP-321, described in US 2011/007023, WO08/132601, and WO09/44273. Anti-LAG-3 antibodies that compete with and/or bind to the same epitope as that of any of these antibodies can also be used in combination treatments.

In some embodiments, an anti-TIM3 antibody of the disclosure can be administered in combination with a CD137 (4-1BB) agonist, such as an agonistic CD137 antibody. Suitable CD137 antibodies include, for example, urelumab or PF-05082566 (WO12/32433).

In some embodiments, an anti-TIM3 antibody can be administered in combination with an OX40 agonist, such as an agonistic OX40 antibody. Suitable OX40 antibodies include, for example, MEDI-6383, MEDI-6469 or MOXR0916 (RG7888; WO06/029879).

In some embodiments, an anti-TIM3 antibody is administered in combination with a CD40 agonist, such as an agonistic CD40 antibody. In some embodiments, the immuno-oncology agent is a CD40 antagonist, such as an antagonistic CD40 antibody. Suitable CD40 antibodies include, for example, lucatumumab (HCD122), dacetuzumab (SGN-40), CP-870,893 or Chi Lob 7/4.

In some embodiments, an anti-TIM3 antibody is administered in combination with a CD27 agonist, such as an agonistic CD27 antibody. Suitable CD27 antibodies include, for example, varlilumab (CDX-1127).

In some embodiments, the anti-TIM3 antibody is administered together with an anti-GITR antibody, e.g., an antibody having the CDR sequences of 6C8, e.g., a humanized antibody having the CDRs of 6C8, as described, e.g., in WO2006/105021; an antibody comprising the CDRs of an anti-GITR antibody described in WO2011/028683; an antibody comprising the CDRs of an anti-GITR antibody described in JP2008278814, an antibody comprising the CDRs of an anti-GITR antibody described in WO2015/031667, WO2015/187835, WO2015/184099, WO2016/054638, WO2016/057841 or WO2016/057846 or other anti-GITR antibody described or referred to herein.

In some embodiments, an anti-TIM3 antibody is administered in combination with MGA271 (to B7H3) (WO11/109400).

In some embodiments, an anti-TIM3 antibody is administered in combination with a KIR antagonist, such as lirilumab.

In some embodiments, an anti-TIM3 antibody is administered in combination with an IDO antagonist. Suitable IDO antagonists include, for example, INCB-024360 (WO2006/122150, WO07/75598, WO08/36653, WO08/36642), indoximod, NLG-919 (WO09/73620, WO09/1156652, WO11/56652, WO12/142237) or F001287.

In some embodiments, an anti-TIM3 antibody is administered in combination with a Toll-like receptor agonist, e.g., a TLR2/4 agonist (e.g., Bacillus Calmette-Guerin); a TLR7 agonist (e.g., Hiltonol or Imiquimod); a TLR7/8 agonist (e.g., Resiquimod); or a TLR9 agonist (e.g., CpG7909).

In some embodiments, an anti-TIM3 is administered in combination with a TGF-β inhibitor, e.g., GC1008, LY2157299, TEW7197, or IMC-TR1.

The anti-TIM3 antibodies and combination therapies described herein can also be used in conjunction with other well-known therapies that are selected for their particular usefulness against the indication being treated (e.g., cancer). Combinations of the anti-TIM3 antibodies described herein can be used sequentially with known pharmaceutically acceptable agent(s).

For example, the anti-TIM3 antibodies and combination therapies described herein can be used in combination (e.g., simultaneously or separately) with an additional treatment, such as irradiation and/or chemotherapy, e.g., using camptothecin (CPT-11), 5-fluorouracil (5-FU), cisplatin, doxorubicin, irinotecan, paclitaxel, gemcitabine, cisplatin, paclitaxel, carboplatin-paclitaxel (Taxol), doxonrbicin, or camptothecin+apo21/TRAIL (a 6× combo)), one or more proteasome inhibitors (e.g., bortezomib or MG132), one or more Bcl-2 inhibitors (e.g., BH3I-2' (bcl-xl inhibitor), indoleamine dioxygenase-1 inhibitor (e.g., INCB24360, indoximod, NLG-919, or F001287), AT-101 (R-(-)-gossypol derivative), ABT-263 (small molecule), GX-15-070 (obatoclax), or MCL-1 (myeloid leukemia cell differentiation protein-1) antagonists), iAP (inhibitor of apoptosis protein) antagonists (e.g., smac7, smac4, small molecule smac mimetic, synthetic smac peptides (see Fulda et al., *Nat Med* 2002; 8:808-15), ISIS23722 (LY2181308), or AEG-35156 (GEM-640)), HDAC (histone deacetylase) inhibitors, anti-CD20 antibodies (e.g., rituximab), angiogenesis inhibitors (e.g., bevacizumab), anti-angiogenic agents targeting VEGF and VEGFR (e.g., Avastin), synthetic triterpenoids (see Hyer et al, *Cancer Research* 2005; 65:4799-808), c-FLIP (cellular FLICE-inhibitory protein) modulators (e.g., natural and synthetic ligands of PPARy (peroxisome proliferator-activated receptor γ), 5809354 or 5569100), kinase inhibitors (e.g., Sorafemb), Trastuzumab, Cetuximab, Temsirolimus, mTOR inhibitors such as rapamycin and temsirolimus, Bortezomib, JAK2 inhibitors, HSP90 inhibitors, PI3K-AKT inhibitors, Lenalildomide, GSK3P inhibitors, IAP inhibitors and/or genotoxic drugs.

The anti-TIM3 antibodies and combination therapies described herein can further be used in combination with one or more anti-proliferative cytotoxic agents. Classes of compounds that can be used as anti-proliferative cytotoxic agents include, but are not limited to, the following:

Alkylating agents (including, without limitation, nitrogen mustards, ethylenimine derivatives, alkyl sulfonates, nitrosoureas and triazenes): Uracil mustard, Chlormethine, Cyclophosphamide (CYTOXAN®) fosfamide, Melphalan, Chlorambucil, Pipobroman, Triethylenemelamine, Triethylenethiophosphoramine, Busulfan, Carmustine, Lomustine, Streptozocin, Dacarbazine, and Temozolomide.

Antimetabolites (including, without limitation, folic acid antagonists, pyrimidine analogs, purine analogs and adenosine deaminase inhibitors): Methotrexate, 5-Fluorouracil, Floxuridine, Cytarabine, 6-Mercaptopurine, 6-Thioguanine, Fludarabine phosphate, Pentostatine, and Gemcitabine.

Suitable anti-proliferative agents for combining with anti-TIM3 antibodies, without limitation, taxanes, paclitaxel (paclitaxel is commercially available as TAXOL™), docetaxel, discodermolide (DDM), dictyostatin (DCT), Peloruside A, epothilones, epothilone A, epothilone B, epothilone C, epothilone D, epothilone E, epothilone F, furanoepothilone D, desoxyepothilone B1, [17]-dehydrodesoxyepothilone B, [18]dehydrodesoxyepothilones B, C12,13-cyclopropyl-epothilone A, C6-C8 bridged epothilone A, trans-9,10-dehydroepothilone D, cis-9,10-dehydroepothilone D, 16-desmethylepothilone B, epothilone BIO, discodermolide, patupilone (EPO-906), KOS-862, KOS-1584, ZK-EPO, ABJ-789, XAA296A (Discodermolide), TZT-1027 (soblidotin), ILX-651 (tasidotin hydrochloride), Halichondrin B, Eribulin mesylate (E-7389), Hemiasterlin (HTI-286), E-7974, Cyrptophycins, LY-355703, Maytansinoid immunoconjugates (DM-1), MKC-1, ABT-751, T1-38067, T-900607, SB-715992 (ispinesib), SB-743921, MK-0731, STA-5312, eleutherobin, 17beta-acetoxy-2-ethoxy-6-oxo-B-homo-estra-1,3,5(10)-trien-3-ol, cyclostreptin, isolaulimalide, laulimalide, 4-epi-7-dehydroxy-14,16-didemethyl-(+)-discodermolides, and cryptothilone 1, in addition to other microtubuline stabilizing agents known in the art.

In cases where it is desirable to render aberrantly proliferative cells quiescent in conjunction with or prior to treatment with anti-TIM3 antibodies described herein, hormones and steroids (including synthetic analogs), such as 17a-Ethinylestradiol, Diethylstilbestrol, Testosterone, Prednisone, Fluoxymesterone, Dromostanolone propionate, Testolactone, Megestrolacetate, Methylprednisolone, Methyltestosterone, Prednisolone, Triamcinolone, Chlorotrianisene, Hydroxyprogesterone, Aminoglutethimide, Estramustine, Medroxyprogesteroneacetate, Leuprolide, Flutamide, Toremifene, ZOLADEX® (goserelin implant), can also be administered to the patient. When employing the methods or compositions described herein, other agents used in the modulation of tumor growth or metastasis in a clinical setting, such as antimimetics, can also be administered as desired.

In some embodiments, the combination of the anti-TIM3 antibody and a second agent discussed herein can be administered concurrently as a single composition in a pharmaceutically acceptable carrier, or concurrently as separate compositions with the anti-TIM3 antibody and the second agent in a pharmaceutically acceptable carrier. In some embodiments, the combination of the anti-TIM3 antibody and the second agent can be administered sequentially. The administration of the two agents can start at times that are, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks apart, or administration of the second agent can start, e.g., 30 minutes, 60 minutes, 90 minutes, 120 minutes, 3 hours, 6 hours, 12 hours, 24 hours, 36 hours, 48 hours, 3 days, 5 days, 7 days, or one or more weeks after the first agent has been administered.

In some embodiments, an anti-neoplastic antibody that can be combined with an anti-TIM3 antibody and/or a second agent includes RITUXAN® (rituximab), HERCEPTIN® (trastuzumab), BEXXAR® (tositumomab), ZEVALIN® (ibritumomab), CAMPATH® (alemtuzumab), LYMPHOCIDE® (eprtuzumab), AVASTIN® (bevacizumab), and TARCEVA® (erlotinib), or any combination thereof. In some embodiments, the second antibody useful for the combination therapy with an anti-TIM3 antibody can be an antibody drug conjugate.

In some embodiments, an anti-TIM3 antibody alone or in combination with another agent is used concurrently or sequentially with bone marrow transplantation to treat a variety of tumors of hematopoietic origin.

Provided herein are methods for altering an adverse event associated with treatment of a hyperproliferative disease (e.g., cancer) with an immuno stimulatory agent, comprising administering an anti-TIM3 antibody with or without a second agent, to a subject. For example, the methods described herein provide for a method of reducing the incidence of immuno stimulatory therapeutic antibody-induced colitis or diarrhea by administering a non-absorbable steroid to the patient. As used herein, a "non-absorbable steroid" is a glucocorticoid that exhibits extensive first pass metabolism such that, following metabolism in the liver, the bioavailability of the steroid is low, i.e., less than about 20%. In some embodiments described herein, the non-absorbable steroid is budesonide. Budesonide is a locally-acting glucocorticosteroid, which is extensively metabolized, primarily by the liver, following oral administration. ENTOCORT EC® (Astra-Zeneca) is a pH- and time-dependent oral formulation of budesonide developed to optimize drug delivery to the ileum and throughout the colon. ENTOCORT EC® is approved in the U.S. for the treatment of mild to moderate Crohn's disease involving the ileum and/or ascending colon. In some embodiments, an anti-TIM3 antibody in conjunction with a non-absorbable steroid can be further combined with a salicylate. Salicylates include 5-ASA agents such as, for example: sulfasalazine (AZULFIDINE®, Pharmacia & Up John); olsalazine (DJPENTUM®, Pharmacia & Up John); balsalazide (COLAZAL®, Salix Pharmaceuticals, Inc.); and mesalamine (ASACOL®, Procter & Gamble Pharmaceuticals; PENTASA®, Shire US; CANASA®, Axcan Scandipharm, Inc.; ROWASA®, Solvay).

TABLE 1

| SEQ ID | Description | Sequences |
|---|---|---|
| 45 | 14H7/TIM3.24 VH CDR1 | DYYMS |
| 413 | 14H7/TIM3.24 VH CDR2 | YISNSGSIIYYADSVKG |
| 414 | 14H7/TIM3.24 VH CDR3 | GRIGFFDY |
| 64 | 14H7/TIM3.24 VL CDR1 | RASQSVSSSYLA |
| 66 | 14H7/TIM3.24 VL CDR2 | GASSRAT |
| 69 | 14H7/TIM3.24 VL CDR3 | QQYGSSPLT |
| 410 | 14H7/TIM3.24 VH | QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSS |
| 417 | 14H7/TIM3.24 VL | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGPGTKVDIK |
| 45 | 23B3 VH CDR1 | DYYMS |
| 415 | 23B3 VH CDR2 | FISGSGSIIYYADSVKG |
| 416 | 23B3 VH CDR3 | DGMVRGMNFYGMDV |
| 64 | 23B3 VL CDR1 | RASQSVSSSYLA |
| 66 | 23B3 VL CDR2 | GASSRAT |
| 419 | 23B3 VL CDR3 | QQYGSSP |
| 411 | 23B3 VH | QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSS |
| 418 | 23B3 VL | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFGGGTKVEIK |
| 45 | TIM3.25 VH CDR1 | DYYNS |
| 415 | TIM3.25 VH CDR2 | FISGSGSIIYYADSVKG |
| 416 | TIM3.25 VH CDR3 | DGMVRGMNFYGMDV |
| 64 | TIM3.25 VL CDR1 | RASQSVSSSYLA |
| 66 | TIM3.25 VL CDR2 | GASSRAT |
| 68 | TIM3.25 VL CDR3 | QQYGSSPIT |

TABLE 1-continued

| SEQ ID Description | Sequences |
|---|---|
| 412 TIM3.25 VH | QVQLVESGGGLVKPGGSLRLSCAASGFTFSDYYMSWIRQAPGKGLEWVSFISGSGSIIYYADSVK GRFTISRDNAKNSLYLQMNSLRAEDTAVYYCARDGMVRGMNFYGMDVWGQGTTVTVSS |
| 60 TIM3.25 VL | EIVLTQSPGTLSLSPGERATLSCRASQSVSSSYLAWYQQKPGQAPRLLIYGASSRATGIPDRFSG SGSGTDFTLTISRLEPEDFAVYYCQQYGSSPITFGQGTRLEIK |
| 1 TIM3.5 (13A3) IgG1.1f Heavy Chain | QLQLQESGPGLVKPSETLSLTCTVSGGSISSRSYYWGWIRQPPGKGLEWIGSIYYSGFTYYNPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 2 8B9 IgG1.1f Heavy Chain | QVQLQESGPGLVKPSETLSLTCTVSGGSISRHYWNWIRQPPGKGLEWIGYIHYSGSTNYNSSLKS RVTISVDTSKNQFSLKLSSVTAADTAVYYCARDTGYYGMDIWGQGTTVTVSSASTKGPSVFPLAP SSKSTSGGTAALGCLVKDYFPEPVTVSWNSGALTSGVHTFPAVLQSSGLYSLSSVVTVPSSSLGT QTYICNVNHKPSNTKVDKRVEPKSCDKTHTCPPCPAPEAEGAPSVFLFPPKPKDTLMISRTPEVT CVVVDVSHEDPEVKFNWYVDGVEVHNAKTKPREEQYNSTYRVVSVLTVLHQDWLNGKEYKCKVSN KALPSSIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGK* |
| 3 TIM3.6 (8C4) IgG1.1f Heavy Chain | QVQLQESGPGLVKPSETLSLTCTVSGGSISRYYWSWIRQPPGKGLEWIGYIHYTGSTNYNPSLKS RVTISVDTSKNQFSLKLSSVTAADTAVYYCATDTGYYGMDVWGQGTTVTVSSASTKGPSVFPLAP SSKSTSGGTAALGCLVKDYFPEPVTVSWNSGALTSGVHTFPAVLQSSGLYSLSSVVTVPSSSLGT QTYICNVNHKPSNTKVDKRVEPKSCDKTHTCPPCPAPEAEGAPSVFLFPPKPKDTLMISRTPEVT CVVVDVSHEDPEVKFNWYVDGVEVHNAKTKPREEQYNSTYRVVSVLTVLHQDWLNGKEYKCKVSN KALPSSIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGK* |
| 4 TIM3.2 (17C3) IgG1.1f Heavy Chain | QVQLVQSGAEVKKPGASVKVSCKASGYTFTSYYMHWVRQAPGQGLEWMGIINPRGDSIIYAQKFQ GRVTMTRDTSTSTVYMELSSLRSEDTAVYYCARDFYGSGNYYYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 5 9F6 IgG1.1f Heavy Chain | QVQLVESGGGLVKPGGSLRLSCAASGFTFSDYYMSWIRQAPGKGLEWVSFISGGGSTIYYADSVK GRFTISRDNAKNSLFLQMNSLRVEDTAVYYCARDGYSSGWYYYGMDVWGQGTAVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 6 TIM3.4 (3G4) IgG1.1f Heavy Chain | QVQLVESGGGLVKPGGSLRLSCAASGFTFSDYYMSWIRQAPGKGLEWVSFISTSGSIIYYADSVK GRFTISRDNAKNSLYLQMNSLRAEDTAVYYCAREGYSSWSYYYGMDVWGQGTTVTVSSASTKGP SVFPLAPSSKSTSGGTAALGCLVKDYFPEPVTVSWNSGALTSGVHTFPAVLQSSGLYSLSSVVTV PSSSLGTQTYICNVNHKPSNTKVDKRVEPKSCDKTHTCPPCPAPEAEGAPSVFLFPPKPKDTLMI SRTPEVTCVVVDVSHEDPEVKFNWYVDGVEVHNAKTKPREEQYNSTYRVVSVLTVLHQDWLNGKE YKCKVSNKALPSSIEKTISKAKGQPREPQVYTLPPSREEMTKNQVSLTCLVKGFYPSDIAVEWES NGQPENNYKTTPPVLDSDGSFFLYSKLTVDKSRWQQGNVFSCSVMHEALHNHYTQKSLSLSPGK* |
| 7 TIM3.9 (17C8) IgG1.1f Heavy Chain | QVQLVESGGGLVKPGGSLRLSCAASGFTFSDYYMSWIRQAPGKGLEWVSFISSSGSIIYYADSVK GRFTISRDNAKNSLYLQMNSLRAEDTAVYYCARDGYSSGWEYYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 8 TIM3.5 (13A3) IgG1.1f Heavy Chain (without C-terminal K) | QLQLQESGPGLVKPSETLSLTCTVSGGSISSRSYYWGWIRQPPGKGLEWIGSIYYSGFTYYNPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 9 8B9 IgG1.1f Heavy Chain (without C-terminal K) | QVQLQESGPGLVKPSETLSLTCTVSGGSISRHYWNWIRQPPGKGLEWIGYIHYSGSTNYNSSLKS RVTISVDTSKNQFSLKLSSVTAADTAVYYCARDTGYYGMDIWGQGTTVTVSSASTKGPSVFPLAP SSKSTSGGTAALGCLVKDYFPEPVTVSWNSGALTSGVHTFPAVLQSSGLYSLSSVVTVPSSSLGT QTYICNVNHKPSNTKVDKRVEPKSCDKTHTCPPCPAPEAEGAPSVFLFPPKPKDTLMISRTPEVT CVVVDVSHEDPEVKFNWYVDGVEVHNAKTKPREEQYNSTYRVVSVLTVLHQDWLNGKEYKCKVSN KALPSSIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPG* |

TABLE 1-continued

| SEQ ID | Description | Sequences |
|---|---|---|
| 10 | TIM3.6 (8C4) IgG1.1f Heavy Chain (without C-terminal K) | QVQLQESGPGLVKPSETLSLTCTVSGGSISRYYWSWIRQPPGKGLEWIGYIHYTGSTNYNPSLKS RVTISVDTSKNQFSLKLSSVTAADTAVYYCATDGYYGMDVWGQGTTVTVSSASTKGPSVFPLAP SSKSTSGGTAALGCLVKDYFPEPVTVSWNSGALTSGVHTFPAVLQSSGLYSLSSVVTVPSSSLGT QTYICNVNHKPSNTKVDKRVEPKSCDKTHTCPPCPAPEAEGAPSVFLFPPKPKDTLMISRTPEVT CVVVDVSHEDPEVKFNWYVDGVEVHNAKTKPREEQYNSTYRVVSVLTVLHQDWLNGKEYKCKVSN KALPSSIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPG* |
| 11 | TIM3.2 (17C3) IgG1.1f Heavy Chain (without C-terminal K) | QVQLVQSGAEVKKPGASVKVSCKASGYTFTSYYMHWVRQAPGQGLEWMGIINPRGDSIIYAQKFQ GRVTMTRDTSTSTVYMELSSLRSEDTAVYYCARDFYGSGNYYYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 12 | 9F6 IgG1.1f Heavy Chain (without C-terminal K) | QVQLVESGGGLVKPGGSLRLSCAASGFTFSDYYMSWIRQAPGKGLEWVSFISGGGSTIYYADSVK GRFTISRDNAKNSLFLQMNSLRVEDTAVYYCARDGYSSGWYYYGMDVWGQGTAVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 13 | TIM3.4 (3G4) IgG1.1f Heavy Chain (without C-terminal K) | QVQLVESGGGLVKPGGSLRLSCAASGFTFSDYYMSWIRQAPGKGLEWVSFISTSGSIIYYADSVK GRFTISRDNAKNSLYLQMNSLRAEDTAVYYCAREGYSSSWSYYYGMDVWGQGTTVTVSSASTKGP SVFPLAPSSKSTSGGTAALGCLVKDYFPEPVTVSWNSGALTSGVHTFPAVLQSSGLYSLSSVVTV PSSSLGTQTYICNVNHKPSNTKVDKRVEPKSCDKTHTCPPCPAPEAEGAPSVFLFPPKPKDTLMI SRTPEVTCVVVDVSHEDPEVKFNWYVDGVEVHNAKTKPREEQYNSTYRVVSVLTVLHQDWLNGKE YKCKVSNKALPSSIEKTISKAKGQPREPQVYTLPPSREEMTKNQVSLTCLVKGFYPSDIAVEWES NGQPENNYKTTPPVLDSDGSFFLYSKLTVDKSRWQQGNVFSCSVMHEALHNHYTQKSLSLSPG* |
| 14 | TIM3.9 (17C8) IgG1.1f Heavy Chain (without C-terminal K) | QVQLVESGGGLVKPGGSLRLSCAASGFTFSDYYMSWIRQAPGKGLEWVSFISSSGSIIYYADSVK GRFTISRDNAKNSLYLQMNSLRAEDTAVYYCARDGYSSGWEYYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLEPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 15 | TIM3.5 (13A3) IgG1.3f Heavy Chain | QLQLQESGPGLVKPSETLSLTCTVSGGSISRSYYWGWIRQPPGKGLEWIGSIYYSGFTYYNPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFELYSKLTVDKSRWQQGNVESCSVMHEALHNHYTQKSLSLSPGK* |
| 16 | 8B9 IgG1.3f Heavy Chain | QVQLQESGPGLVKPSETLSLTCTVSGGSISRHYWNWIRQPPGKGLEWIGYIHYSGSTNYNSSLKS RVTISVDTSKNQFSLKLSSVTAADTAVYYCARDTGYYGMDIWGQGTTVTVSSASTKGPSVFPLAP SSKSTSGGTAALGCLVKDYFPEPVTVSWNSGALTSGVHTFPAVLQSSGLYSLSSVVTVPSSSLGT QTYICNVNHKPSNTKVDKRVEPKSCDKTHTCPPCPAPEAEGAPSVFLFPPKPKDTLMISRTPEVT CVVVDVSHEDPEVKFNWYVDGVEVHNAKTKPREEQYNSTYRVVSVLTVLHQDWLNGKEYKCKVSN KALPAPIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGK* |
| 17 | TIM3.6 (8C4) IgG1.3f Heavy Chain | QVQLQESGPGLVKPSETLSLTCTVSGGSISRYYWSWIRQPPGKGLEWIGYIHYTGSTNYNPSLKS RVTISVDTSKNQFSLKLSSVTAADTAVYYCATDGYYGMDVWGQGTTVTVSSASTKGPSVFPLAP SSKSTSGGTAALGCLVKDYFPEPVTVSWNSGALTSGVHTFPAVLQSSGLYSLSSVVTVPSSSLGT QTYICNVNHKPSNTKVDKRVEPKSCDKTHTCPPCPAPEAEGAPSVFLFPPKPKDTLMISRTPEVT CVVVDVSHEDPEVKFNWYVDGVEVHNAKTKPREEQYNSTYRVVSVLTVLHQDWLNGKEYKCKVSN KALPAPIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGIK* |
| 18 | TIM3.2 (17C3) IgG1.3f Heavy Chain | QVQLVQSGAEVKKPGASVKVSCKASGYTFTSYYMHWVRQAPGQGLEWMGIINPRGDSIIYAQKFQ GRVTMTRDTSTSTVYMELSSLRSEDTAVYYCARDFYGSGNYYYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFELYSKLTVDKSRWQQGNVESCSVMHEALHNHYTQKSLSLSPGR* |
| 19 | 9F6 IgG1.3f Heavy Chain | QVQLVESGGGLVKPGGSLRLSCAASGFTFSDYYMSWIRQAPGKGLEWVSFISGGGSTIYYADSVK GRFTISRDNAKNSLFLQMNSLRVEDTAVYYCARDGYSSGWYYYGMDVWGQGTAVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS |

TABLE 1-continued

| SEQ ID Description | Sequences |
|---|---|
| | RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFELYSKLTVDKSRWQQGNVESCSVMHEALHNHYTQKSLSLSPGR* |
| 20 TIM3.4 (3G4) IgG1.3f Heavy Chain | QVQLVESGGGLVKPGGSLRLSCAASGFTFSDYYMSWIRQAPGKGLEWVSFISTSGSIIYYADSVK<br>GRFTISRDNAKNSLYLQMNSLRAEDTAVYYCAREGYSSSWSYYYGMDVWGQGTTVTVSSASTKGP<br>SVFPLAPSSKSTSGGTAALGCLVKDYFPEPVTVSWNSGALTSGVHTFPAVLQSSGLYSLSSVVTV<br>PSSSLGTQTYICNVNHKPSNTKVDKRVEPKSCDKTHTCPPCPAPEAEGAPSVFLFPPKPKDTLMI<br>SRTPEVTCVVVDVSHEDPEVKFNWYVDGVEVHNAKTKPREEQYNSTYRVVSVLTVLHQDWLNGKE<br>YKCKVSNKALPAPIEKTISKAKGQPREPQVYTLPPSREEMTKNQVSLTCLVKGFYPSDIAVEWES<br>NGQPENNYKTTPPVLDSDGSFFLYSKLTVDKSRWQQGNVFSCSVMHEALHNHYTQKSLSLSPGK* |
| 21 TIM3.9 (17C8) IgG1.3f Heavy Chain | QVQLVESGGGLVKPGGSLRLSCAASGFTFSDYYMSWIRQAPGKGLEWVSFISSSGSIIYYADSVK<br>GRFTISRDNAKNSLYLQMNSLRAEDTAVYYCARDGYSSGWEYYGMDVWGQGTTVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFELYSKLTVDKSRWQQGNVESCSVMHEALHNHYTQKSLSLSPGR* |
| 22 TIM3.5 (13A3) IgG1.3f Heavy Chain (no C-terminal K) | QLQLQESGPGLVKPSETLSLTCTVSGGSISSRSYYWGWIRQPPGKGLEWIGSIYYSGFTYYNPSL<br>KSPVTISVDTSKNQFSLKLSSVTAADTAVYYCATGGPYGDYAHWFDPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPG* |
| 23 8B9 IgG1.3f Heavy Chain (no C-terminal K) | QVQLQESGPGLVKPSETLSLTCTVSGGSISRHYWNWIRQPPGKGLEWIGYIHYSGSTNYNSSLKS<br>RVTISVDTSKNQFSLKLSSVTAADTAVYYCARDTGYYGMDIWGQGTTVTVSSASTKGPSVFPLAP<br>SSKSTSGGTAALGCLVKDYFPEPVTVSWNSGALTSGVHTFPAVLQSSGLYSLSSVVTVPSSSLGT<br>QTYICNVNHKPSNTKVDKRVEPKSCDKTHTCPPCPAPEAEGAPSVFLFPPKPKDTLMISRTPEVT<br>CVVVDVSHEDPEVKFNWYVDGVEVHNAKTKPREEQYNSTYRVVSVLTVLHQDWLNGKEYKCKVSN<br>KALPAPIEKTISKAKGQPREPQVYTLPPSREEMTKNQVSLTCLVKGFYPSDIAVEWESNGQPENN<br>YKTTPPVLDSDGSFFLYSKLTVDKSRWQQGNVFSCSVMHEALHNHYTQKSLSLSPG* |
| 24 TIM3.6 (8C4) IgG1.3f Heavy Chain (no C-terminal K) | QVQLQESGPGLVKPSETLSLTCTVSGGSISRYYWSWIRQPPGKGLEWIGYIHYTGSTNYNPSLKS<br>RVTISVDTSKNQFSLKLSSVTAADTAVYYCATDTGYYGMDVWGQGTTVTVSSASTKGPSVFPLAP<br>SSKSTSGGTAALGCLVKDYFPEPVTVSWNSGALTSGVHTFPAVLQSSGLYSLSSVVTVPSSSLGT<br>QTYICNVNHKPSNTKVDKRVEPKSCDKTHTCPPCPAPEAEGAPSVFLFPPKPKDTLMISRTPEVT<br>CVVVDVSHEDPEVKFNWYVDGVEVHNAKTKPREEQYNSTYRVVSVLTVLHQDWLNGKEYKCKVSN<br>KALPAPIEKTISKAKGQPREPQVYTLPPSREEMTKNQVSLTCLVKGPYPSDIAVEWESNGQPENN<br>YKTTPPVLDSDGSFFLYSKLTVDKSRWQQGNVFSCSVMHEALHNHYTQKSLSLSPG* |
| 25 TIM3.2 (17C3) IgG1.3f Heavy Chain (no C-terminal K) | QVQLVQSGAEVKKPGASVKVSCKASGYTFTSYYMHWVRQAPGQGLEWMGIINPRGDSIIYAQKFQ<br>GRVTMTRDTSTSTVYMELSSLRSEDTAVYYCARDFYGSGNYYYGMDVWGQGTTVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPG* |
| 26 9F6 IgG1.3f Heavy Chain (no C-terminal K) | QVQLVESGGGLVKPGGSLRLSCAASGFTFSDYYMSWIRQAPGKGLEWVSFISGGGSTIYYADSVK<br>GRFTISRDNAKNSLFLQMNSLRVEDTAVYYCARDGYSSGWYYYGMDVWGQGTAVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPG* |
| 27 TIM3.4 (3G4) IgG1.3f Heavy Chain (no C-terminal K) | QVQLVESGGGLVKPGGSLRLSCAASGFTFSDYYMSWIRQAPGKGLEWVSFISTSGSIIYYADSVK<br>GRFTISRDNAKNSLYLQMNSLRAEDTAVYYCAREGYSSSWSYYYGMDVWGQGTTVTVSSASTKGP<br>SVFPLAPSSKSTSGGTAALGCLVKDYFPEPVTVSWNSGALTSGVHTFPAVLQSSGLYSLSSVVTV<br>PSSSLGTQTYICNVNHKPSNTKVDKRVEPKSCDKTHTCPPCPAPEAEGAPSVFLFPPKPKDTLMI<br>SRTPEVTCVVVDVSHEDPEVKFNWYVDGVEVHNAKTKPREEQYNSTYRVVSVLTVLHQDWLNGKE<br>YKCKVSNKALPAPIEKTISKAKGQPREPQVYTLPPSREEMTKNQVSLTCLVKGFYPSDIAVEWES<br>NGQPENNYKTTPPVLDSDGSFFLYSKLTVDKSRWQQGNVFSCSVMHEALHNHYTQKSLSLSPG* |
| 28 TIM3.9 (17C8) IgG1.3f Heavy Chain (no C-terminal K) | QVQLVESGGGLVKPGGSLRLSCAASGFTFSDYYMSWIRQAPGKGLEWVSFISSSGSIIYYADSVK<br>GRFTISRDNAKNSLYLQMNSLRAEDTAVYYCARDGYSSGWEYYGMDVWGQGTTVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPG* |

TABLE 1-continued

| SEQ ID Description | Sequences |
|---|---|
| 72 TIM3.10 (13A3) IgG1.1f (N60Q) Heavy Chain | QLQLQESGPGLVKPSETLSLTCTVSGGSISSRSYYWGWIRQPPGKGLEWIGSIYYSGFTYYQPSL<br>KSRVTISVDTSKNQFSLKLSSVTAADTAVYYCATGGPYGDYAHWFDPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPSSIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 73 TIM3.11 (13A3) IgG1.1f (N60S) Heavy Chain | QLQLQESGPGLVKPSETLSLTCTVSGGSISSRSYYWGWIRQPPGKGLEWIGSIYYSGFTYYSPSL<br>KSRVTISVDTSKNQFSLKLSSVTAADTAVYYCATGGPYGDYAHWFDPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPSSIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 74 TIM3.12 (13A3) IgG1.1f (N60A) Heavy Chain | QLQLQESGPGLVKPSETLSLTCTVSGGSISSRSYYWGWIRQPPGKGLEWIGSIYYSGFTYYAPSL<br>KSRVTISVDTSKNQFSLKLSSVTAADTAVYYCATGGPYGDYAHWFDPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPSSIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 75 TIM3.13 (13A3) IgG1.1f (D101E) Heavy Chain | QLQLQESGPGLVKPSETLSLTCTVSGGSISSRSYYWGWIRQPPGKGLEWIGSIYYSGFTYYNPSL<br>KSRVTISVDTSKNQFSLKLSSVTAADTAVYYCATGGPYGDYAHWFEPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPSSIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 76 TIM3.14 (13A3) IgG1.1f (P102V) Heavy Chain | QLQLQESGPGLVKPSETLSLTCTVSGGSISSRSYYWGWIRQPPGKGLEWIGSIYYSGFTYYNPSL<br>KSRVTISVDTSKNQFSLKLSSVTAADTAVYYCATGGPYGDYAHWFDVWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPSSIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 77 TIM3.15 (13A3) IgG1.1f (P102Y) Heavy Chain | QLQLQESGPGLVKPSETLSLTCTVSGGSISSRSYYWGWIRQPPGKGLEWIGSIYYSGFTYYNPSL<br>KSRVTISVDTSKNQFSLKLSSVTAADTAVYYCATGGPYGDYAHWFDYWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPSSIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 78 TIM3.16 (13A3) IgG1.1f (P102L) Heavy Chain | QLQLQESGPGLVKPSETLSLTCTVSGGSISSRSYYWGWIRQPPGKGLEWIGSIYYSGFTYYNPSL<br>KSRVTISVDTSKNQFSLKLSSVTAADTAVYYCATGGPYGDYAHWFDLWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPSSIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 79 TIM3.17 (13A3) IgG1.1f (N60Q/P102Y) Heavy Chain | QLQLQESGPGLVKPSETLSLTCTVSGGSISSRSYYWGWIRQPPGKGLEWIGSIYYSGFTYYQPSL<br>KSRVTISVDTSKNQFSLKLSSVTAADTAVYYCATGGPYGDYAHWFDYWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPSSIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 349 TIM3.18 (13A3) IgG1.1f (N60Q/D101E) Heavy Chain | QLQLQESGPGLVKPSETLSLTCTVSGGSISSRSYYWGWIRQPPGKGLEWIGSIYYSGFTYYQPSL<br>KSRVTISVDTSKNQFSLKLSSVTAADTAVYYCATGGPYGDYAHWFEPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPSSIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 80 TIM3.8 (8B9) IgG1.1f (S61P) Heavy Chain | QVQLQESGPGLVKPSETLSLTCTVSCGSISRHYWNWIRQPPGKGLEWIGYIHYSGSTNYNPSLKS<br>RVTISVDTSKNQFSLKLSSVTAADTAVYYCARDTGYYGMDIWGQGTTVTVSSASTKGPSVFPLAP<br>SSKSTSGGTAALGCLVKDYFPEPVTVSWNSGALTSGVHTFPAVLQSSGLYSLSSVVTVPSSSLGT<br>QTYICNVNHKPSNTKVDKRVEPKSCDKTHTCPPCPAPEAEGAPSVFLFPPKPKDTLMISRTPEVT<br>CVVVDVSHEDPEVKFNWYVDGVEVHNAKTKPREEQYNSTYRVVSVLTVLHQDWLNGKEYKCKVSN |

TABLE 1-continued

| SEQ ID Description | Sequences |
|---|---|
| | KALPSSIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPGK* |
| 81 TIM3.7 (9F6) IgG1.1f (A108T) Heavy Chain | QVQLVESGGGLVKPGGSLRLSCAASGFTFSDYYMSWIRQAPGKGLEWVSFISGGGSTIYYADSVK GRFTISRDNAKNSLFLQMNSLRVEDTAVYYCARDGYSSGWYYYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 388 TIM3.24/14H7 IgG1.1f Heavy Chain | QVHLVESGGGLVKPGGSLRLSCTAFSDYYMSWIRQAPGKGLEWLSYISNSGSIIYYADSVKGRFT ISRDNAKNSVYLQMNSLRAEDTAVYYCARGRIGFFDYWGPGTLVTVSS<u>ASTKGPSVFPLAPSSKS TSGGTAALGCLVKDYFPEPVTVSWNSGALTSGVHTFPAVLQSSGLYSLSSVVTVPSSSLGTQTYI CNVNHKPSNTKVDKRVEPKSCDKTHTCPPCPAPEAEGAPSVFLFPPKPKDTLMISRTPEVTCVVV DVSHEDPEVKFNWYVDGVEVHNAKTKPREEQYNSTYRVVSVLTVLHQDWLNGKEYKCKVSNKALP SSIEKTISKAKGQPREPQVYTLPPSREEMTKNQVSLTCLVKGFYPSDIAVEWESNGQPENNYKTT PPVLDSDGSFFLYSKLTVDKSRWQQGNVESCSVMHEALHNHYTQKSLSLSPGK*</u> |
| 396 23B3 IgG1.1f Heavy Chain | QVQLVGSGGGLVKPGGSLRLSCAASGETFSDYYMSWIRQAPGKGLEWVSFISGSGSIIYYADSVK GRFTISRDNAKNSLDLQMNSLRAEDTAVYYCARDGMVRGMNFYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 402 TIM3.25 (23B3) IgG1.1f (G6E, D79Y) Heavy Chain | QVQLVESGGGLVKPGGSLRLSCAASGFTFSDYYMSWIRQAPGKGLEWVSFISGSGSIIYYADSVK GRFTISRDNAKNSLYLQMNSLRAEDTAVYYCARDGMVRGMNFYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 82 TIM3.10 (13A3) IgG1.1f (N60Q) Heavy Chain (no C-terminal K) | QLQLQESGPGLVKPSETLSLTCTVSGGSISSRSYYWGWIRQPPGKGLEWIGSIYYSGFTYYQPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 83 TIM3.11 (13A3) IgG1.1f (N60S) Heavy Chain (no C-terminal K) | QLQLQESGPGLVKPSETLSLTCTVSGGSISSRSYYWGWIRQPPGKGLEWIGSIYYSGFTYYSPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 84 TIM3.12 (13A3) IgG1.1f (N60A) Heavy Chain (no C-terminal K) | QLQLQESGPGLVKPSETLSLTCTVSGGSISSRSYYWGWIRQPPGKGLEWIGSIYYSGFTYYAPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 85 TIM3.13 (13A3) IgG1.1f (D101E) Heavy Chain (no C-terminal K) | QLQLQESGPGLVKPSETLSLTCTVSGGSISSRSYYWGWIRQPPGKGLEWIGSIYYSGFTYYNPSL KSRVTISVDTSKNQFSLKLSSVTAADTAVYYCATGGPYGDYAHWFEPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 86 TIM3.14 (13A3) IgG1.1f (P102V) Heavy Chain (no C-terminal K) | QLQLQESGPGLVKPSETLSLTCTVSGGSISSRSYYWGWIRQPPGKGLEWIGSIYYSGFTYYNPSL KSRVTISVDTSKNQFSLKLSSVTAADTAVYYCATGGPYGDYAHWFDVWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 87 TIM3.15 (13A3) IgG1.1f (P102Y) | QLQLQESGPGLVKPSETLSLTCTVSGGSISSRSYYWGWIRQPPGKGLEWIGSIYYSGFTYYNPSL KSRVTISVDTSKNQFSLKLSSVTAADTAVYYCATGGPYGDYAHWFDYWGQGTLVTVSSASTKGPS |

TABLE 1-continued

| SEQ ID Description | Sequences |
|---|---|
| Heavy Chain (no C-terminal K) | VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 88 TIM3.16 (13A3) IgG1.1f (P102L) Heavy Chain (no C-terminal K) | QLQLQESGPGLVKPSETLSLTCTVSGGSISSRSYYWGWIRQPPGKGLEWIGSIYYSGFTYYNPSL KSRVTISVDTSKNQFSLKLSSVTAADTAVYYCATGGPYGDYAHWFDLWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 89 TIM3.17 (13A3) IgG1.1f (N60Q/P102Y) Heavy Chain (no C-terminal K) | QLQLQESGPGLVKPSETLSLTCTVSGGSISSRSYYWGWIRQPPGKGLEWIGSIYYSGFTYYQPSL KSRVTISVDTSKNQFSLKLSSVTAADTAVYYCATGGPYGDYAHWFDYWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 350 TIM3.18 (13A3) IgG1.1f (N60Q/D101E) Heavy Chain (no C-terminal K) | QLQLQESGPGLVKPSETLSLTCTVSGGSISSRSYYWGWIRQPPGKGLEWIGSIYYSGFTYYQPSL KSRVTISVDTSKNQFSLKLSSVTAADTAVYYCATGGPYGDYAHWFEPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 90 TIM3.8 (8B9) IgG1.1f (S61P) Heavy Chain (no C-terminal K) | QVQLQESGPGLVKPSETLSLTCTVSGGSISRHYWNWIRQPPGKGLEWIGYIHYSGSTNYNPSLKS RVTISVDTSKNQFSLKLSSVTAADTAVYYCARDTGYYGMDIWGQGTTVTVSSASTKGPSVFPLAP SSKSTSGGTAALGCLVKDYFPEPVTVSWNSGALTSGVHTFPAVLQSSGLYSLSSVVTVPSSSLGT QTYICNVNHKPSNTKVDKRVEPKSCDKTHTCPPCPAPEAEGAPSVFLFPPKPKDTLMISRTPEVT CVVVDVSHEDPEVKFNWYVDGVEVHNAKTKPREEQYNSTYRVVSVLTVLHQDWLNGKEYKCKVSN KALPSSIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNITYTQKSLSLSPG* |
| 91 TIM3.7 (9F6) IgG1.1f (A108T) Heavy Chain (no C-terminal K) | QVQLVESGGGLVKPGGSLRLSCAASGFTFSDYYMSWIRQAPGKGLEWVSFISGGGSTIYYADSVK GRFTISRDNAKNSLFLQMNSLRVEDTAVYYCARDGYSSGWYYYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 389 TIM3.24/14H7 IgG1.1f Heavy Chain (no C-terminal K) | QVHLVESGGGLVKPGGSLRLSCTAFSDYYMSWIRQAPGKGLEWLSYISNSGSIIYYADSVKGRFT ISRDNAKNSVYLQMNSLRAEDTAVYYCARGRIGFFDYWGPGTLVTVSSASTKGPSVFPLAPSSKS TSGGTAALGCLVKDYFPEPVTVSWNSGALTSGVHTFPAVLQSSGLYSLSSVVTVPSSSLGTQTYI CNVNHKPSNTKVDKRVEPKSCDKTHTCPPCPAPEAEGAPSVFLFPPKPKDTLMISRTPEVTCVVV DVSHEDPEVKFNWYVDGVEVHNAKTKPREEQYNSTYRVVSVLTVLHQDWLNGKEYKCKVSNKALP SSIEKTISKAKGQPREPQVYTLPPSREEMTKNQVSLTCLVKGFYPSDIAVEWESNGQPENNYKTT PPVLDSDGSFFLYSKLTVDKSRWQQGNVFSCSVMHEALHNHYTQKSLSLSPG* |
| 397 23B3 IgG1.1f Heavy Chain (no C-terminal K) | QVQLVGSGGGLVKPGGSLRLSCAASGFTFSDYYMSWIRQAPGKGLEWVSFISGSGSIIYYADSVK GRFTISRDNAKNSLDLQMNSLRAEDTAVYYCARDGMVRGMNFYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 403 TIM3.25 (23B3) IgG1.1f (G6E, D79Y) Heavy Chain (no C-terminal K) | QVQLVESGGGLVKPGGSLRLSCAASGFTFSDYYMSWIRQAPGKGLEWVSFISGSGSIIYYADSVK GRFTISRDNAKNSLYLQMNSLRAEDTAVYYCARDGMVRGMNFYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPSSIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 92 TIM3.10 (13A3) IgG1.3f (N60Q) Heavy Chain | QLQLQESGPGLVKPSETLSLTCTVSGGSISSRSYYWGWIRQPPGKGLEWIGSIYYSGFTYYQPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |

TABLE 1-continued

| SEQ ID | Description | Sequences |
|---|---|---|
| 93 | TIM3.11 (13A3) IgG1.3f (N60S) Heavy Chain | QLQLQESGPGLVKPSETLSLTCTVSGGSISSRSYYWGWIRQPPGKGLEWIGSIYYSGFTYYSPSL<br>KSRVTISVDTSKNQFSLKLSSVTAADTAVYYCATGGPYGDYAHWFDPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 94 | TIM3.12 (13A3) IgG1.3f (N60A) Heavy Chain | QLQLQESGPGLVKPSETLSLTCTVSGGSISSRSYYWGWIRQPPGKGLEWIGSIYYSGFTYYAPSL<br>KSRVTISVDTSKNQFSLKLSSVTAADTAVYYCATGGPYGDYAHWFDPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 95 | TIM3.13 (13A3) IgG1.3f (D101E) Heavy Chain | QLQLQESGPGLVKPSETLSLTCTVSGGSISSRSYYWGWIRQPPGKGLEWIGSIYYSGFTYYNPSL<br>KSRVTISVDTSKNQFSLKLSSVTAADTAVYYCATGGPYGDYAHWFEPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 96 | TIM3.14 (13A3) IgG1.3f (P102V) Heavy Chain | QLQLQESGPGLVKPSETLSLTCTVSGGSISSRSYYWGWIRQPPGKGLEWIGSIYYSGFTYYNPSL<br>KSRVTISVDTSKNQFSLKLSSVTAADTAVYYCATGGPYGDYAHWFDVWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 97 | TIM3.15 (13A3) IgG1.3f (P102Y) Heavy Chain | QLQLQESGPGLVKPSETLSLTCTVSGGSISSRSYYWGWIRQPPGKGLEWIGSIYYSGFTYYNPSL<br>KSRVTISVDTSKNQFSLKLSSVTAADTAVYYCATGGPYGDYAHWFDYWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 98 | TIM3.16 (13A3) IgG1.3f (P102L) Heavy Chain | QLQLQESGPGLVKPSETLSLTCTVSGGSISSRSYYWGWIRQPPGKGLEWIGSIYYSGFTYYNPSL<br>KSRVTISVDTSKNQFSLKLSSVTAADTAVYYCATGGPYGDYAHWFDLWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 99 | TIM3.17 (13A3) IgG1.3f (N60Q/P102Y) Heavy Chain | QLQLQESGPGLVKPSETLSLTCTVSGGSISSRSYYWGWIRQPPGKGLEWIGSIYYSGFTYYQPSL<br>KSRVTISVDTSKNQFSLKLSSVTAADTAVYYCATGGPYGDYAHWFDYWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 351 | TIM3.18 (13A3) IgG1.3f (N60Q/D101E) Heavy Chain | QLQLQESGPGLVKPSETLSLTCTVSGGSISSRSYYWGWIRQPPGKGLEWIGSIYYSGFTYYQPSL<br>KSRVTISVDTSKNQFSLKLSSVTAADTAVYYCATGGPYGDYAHWFEPWGQGTLVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS<br>RTPEVTCVVVDVSHEDPEVKFNWYVDGVEVHNAKTKPREEQYNSTYRVVSVLTVLHQDWLNGKEY<br>KCKVSNKALPAPIEKTISKAKGQPREPQVYTLPPSREEMTKNQVSLTCLVKGFYPSDIAVEWESN<br>GQPENNYKTTPPVLDSDGSFFLYSKLTVDKSRWQQGNVFSCSVMHEALHNHYTQKSLSLSPGK* |
| 100 | TIM3.8 (8B9) IgG1.3f (S61P) Heavy Chain | QVQLQESGPGLVKPSETLSLTCTVSGGSISRHYWNWIRQPPGKGLEWIGYIHYSGSTNYNPSLKS<br>RVTISVDTSKNQFSLKLSSVTAADTAVYYCARDTGYYGMDIWGQGTTVTVSSASTKGPSVFPLAP<br>SSKSTSGGTAALGCLVKDYFPEPVTVSWNSGALTSGVHTFPAVLQSSGLYSLSSVVTVPSSSLGT<br>QTYICNVNHKPSNTKVDKRVEPKSCDKTHTCPPCPAPEAEGAPSVFLFPPKPKDTLMISRTPEVT<br>CVVVDVSHEDPEVKFNWYVDGVEVHNAKTKPREEQYNSTYRVVSVLTVLHQDWLNGKEYKCKVSN<br>KALPAPIEKTISKAKGQPREPQVYTLPPSREEMTKNQVSLTCLVKGFYPSDIAVEWESNGQPENN<br>YKTTPPVLDSDGSFFLYSKLTVDKSRWQQGNVFSCSVMHEALHNHYTQKSLSLSPGK* |
| 101 | TIM3.7 (9F6) IgG1.3f (A108T) Heavy Chain | QVQLVESGGGLVKPGGSLRLSCAASGFTFSDYYMSWIRQAPGKGLEWVSFISGGGSTIYYADSVK<br>GRFTISRDNAKNSLFLQMNSLRVEDTAVYYCARDGYSSGWYYYGMDVWGQGTTVTVSSASTKGPS<br>VFPLAPSSKSTSGGTAALGCLVKDYFPEPVTVSWNSGALTSGVHTFPAVLQSSGLYSLSSVVTVP<br>SSSLGTQTYICNVNHKPSNTKVDKRVEPKSCDKTHTCPPCPAPEAEGAPSVFLFPPKPKDTLMIS |

TABLE 1-continued

| SEQ ID Description | Sequences |
|---|---|
| | RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 390 TIM3.24/14H7 IgG1.3f Heavy Chain | QVHLVESGGGLVKPGGSLRLSCTAFSDYYMSWIRQAPGKGLEWLSYISNSGSIIYYADSVKGRFT ISRDNAKNSVYLQMNSLRAEDTAVYYCARGRIGFFDYWGPGTLVTVSSASTKGPSVFPLAPSSKS TSGGTAALGCLVKDYFPEPVTVSWNSGALTSGVHTFPAVLQSSGLYSLSSVVTVPSSSLGTQTYI CNVNHKPSNTKVDKRVEPKSCDKTHTCPPCPAPEAEGAPSVFLFPPKPKDTLMISRTPEVTCVVV DVSHEDPEVKFNWYVDGVEVHNAKTKPREEQYNSTYRVVSVLTVLHQDWLNGKEYKCKVSNKALP APIEKTISKAKGQPREPQVYTLPPSREEMTKNQVSLTCLVKGFYPSDIAVEWESNGQPENNYKTT PPVLDSDGSFFLYSKLTVDKSRWQQGNVFSCSVMHEALHNHYTQKSLSLSPGK* |
| 398 23B3 IgG1.3f Heavy Chain | QVQLVGSGGGLVKPGGSLRLSCAASGFTFSDYYMSWIRQAPGKGLEWVSFISGSGSIIYYADSVK GRFTISRDNAKNSLDLQMNSLRAEDTAVYYCARDGMVRGMNFYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLEPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 404 TIM3.25 (23B3) IgG1.3f (G6E, D79Y) Heavy Chain | QVQLVESGGGLVKPGGSLRLSCAASGFTFSDYYMSWIRQAPGKGLEWVSFISGSGSIIYYADSVK GRFTISRDNAKNSLYLQMNSLRAEDTAVYYCARDGMVRGMNFYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPGK* |
| 102 TIM3.10 (13A3) IgG1.3f (N60Q) Heavy Chain (no C-terminal K) | QLQLQESGPGLVKPSETLSLTCTVSGGSISSRSYYWGWIRQPPGKGLEWIGSIYYSGFTYYQPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 103 TIM3.11 (13A3) IgG1.3f (N60S) Heavy Chain (no C-terminal K) | QLQLQESGPGLVKPSETLSLTCTVSGGSISSRSYYWGWIRQPPGKGLEWIGSIYYSGFTYYSPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 104 TIM3.12 (13A3) IgG1.3f (N60A) Heavy Chain (no C-terminal K) | QLQLQESGPGLVKPSETLSLTCTVSGGSISSRSYYWGWIRQPPGKGLEWIGSIYYSGFTYYAPSL KSRVTISVDTSKNQFSLKLSSVTAADTAVYYCATGGPYGDYAHWFDPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 105 TIM3.13 (13A3) IgG1.3f (D101E) Heavy Chain (no C-terminal K) | QLQLQESGPGLVKPSETLSLTCTVSGGSISSRSYYWGWIRQPPGKGLEWIGSIYYSGFTYYNPSL KSRVTISVDTSKNQFSLKLSSVTAADTAVYYCATGGPYGDYAHWFEPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 106 TIM3.14 (13A3) IgG1.3f (P102V) Heavy Chain (no C-terminal K) | QLQLQESGPGLVKPSETLSLTCTVSGGSISSRSYYWGWIRQPPGKGLEWIGSIYYSGFTYYNPSL KSRVTISVDTSKNQFSLKLSSVTAADTAVYYCATGGPYGDYAHWFDVWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 107 TIM3.15 (13A3) IgG1.3f (P102Y) Heavy Chain (no C-terminal K) | QLQLQESGPGLVKPSETLSLTCTVSGGSISSRSYYWGWIRQPPGKGLEWIGSIYYSGFTYYNPSL KSRVTISVDTSKNQFSLKLSSVTAADTAVYYCATGGPYGDYAHWFDYWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |

TABLE 1-continued

| SEQ ID Description | Sequences |
|---|---|
| 108 TIM3.16 (13A3) IgG1.3f (P102L) Heavy Chain (no C-terminal K) | QLQLQESGPGLVKPSETLSLTCTVSGGSISSRSYYWGWIRQPPGKGLEWIGSIYYSGFTYYNPSL KSPVTISVDTSKNQFSLKLSSVTAADTAVYYCATGGPYGDYAHWFDLWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 109 TIM3.17 (13A3) IgG1.3f (N60Q/P102Y) Heavy Chain (no C-terminal K) | QLQLQESGPGLVKPSETLSLTCTVSGGSISSRSYYWGWIRQPPGKGLEWIGSIYYSGFTYYQPSL KSPVTISVDTSKNQFSLKLSSVTAADTAVYYCATGGPYGDYAHWFDLWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 352 TIM3.18 (13A3) IgG1.3f (N60Q/D101E) Heavy Chain (no C-terminal K) | QLQLQESGPGLVKPSETLSLTCTVSGGSISSRSYYWGWIRQPPGKGLEWIGSIYYSGFTYYQPSL KSRVTISVDTSKNQFSLKLSSVTAADTAVYYCATGGPYGDYAHWFEPWGQGTLVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 110 TIM3.8 (8B9) IgG1.3f (S61P) Heavy Chain (no C-terminal K) | QVQLQESGPGLVKPSETLSLTCTVSGGSISRHYWNWIRQPPGKGLEWIGYIHYSGSTNYNPSLKS RVTISVDTSKNQFSLKLSSVTAADTAVYYCARDTGYYGMDIWGQGTTVTVSSASTKGPSVFPLAP SSKSTSGGTAALGCLVKDYFPEPVTVSWNSGALTSGVHTFPAVLQSSGLYSLSSVVTVPSSSLGT QTYICNVNHKPSNTKVDKRVEPKSCDKTHTCPPCPAPEAEGAPSVFLFPPKPKDTLMISRTPEVT CVVVDVSHEDPEVKFNWYVDGVEVHNAKTKPREEQYNSTYRVVSVLTVLHQDWLNGKEYKCKVSN KALPAPIEKTISKAKGQPREPQVYTLPPSREEMTKNQVSLTCLVKGFYPSDIAVEWESNGQPENN YKTTPPVLDSDGSFFLYSKLTVDKSRWQQGNVFSCSVMHEALHNHYTQKSLSLSPG* |
| 111 TIM3.7 (9F6) IgG1.3f (A108T) Heavy Chain (no C-terminal K) | QVQLVESGGGLVKPGGSLRLSCAASGFTFSDYYMSWIRQAPGKGLEWVSFISGGGSTIYYADSVK GRFTISRDNAKNSLFLQMNSLRVEDTAVYYCARDGYSSGWYYYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 391 TIM3.24/14H7 IgG1.3f Heavy Chain (no C-terminal K) | QVHLVESGGGLVKPGGSLRLSCTAFSDYYMSWIRQAPGKGLEWLSYISNSGSIIYYADSVKGRFT ISRDNAKNSVYLQMNSLRAEDTAVYYCARGRIGFFDYWGPGTLVTVSSASTKGPSVFPLAPSSKS TSGGTAALGCLVKDYFPEPVTVSWNSGALTSGVHTFPAVLQSSGLYSLSSVVTVPSSSLGTQTYI CNVNHKPSNTKVDKRVEPKSCDKTHTCPPCPAPEAEGAPSVFLFPPKPKDTLMISRTPEVTCVVV DVSHEDPEVKFNWYVDGVEVHNAKTKPREEQYNSTYRVVSVLTVLHQDWLNGKEYKCKVSNKALP APIEKTISKAKGQPREPQVYTLPPSREEMTKNQVSLTCLVKGFYPSDIAVEWESNGQPENNYKTT PPVLDSDGSFFLYSKLTVDKSRWQQGNVFSCSVMHEALHNHYTQKSLSLSPG* |
| 399 23B3 IgG1.1f Heavy Chain (no C-terminal K) | QVQLVGSGGGLVKPGGSLRLSCAASGFTFSDYYMSWIRQAPGKGLEWVSFISGSGSIIYYADSVK GRFTISRDNAKNSLDLQMNSLRAEDTAVYYCARDGMVRGMNFYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 405 TIM3.25 (23B3) IgG1.1f (G6E, D79Y Heavy Chain (no C-terminal K) | QVQLVESGGGLVKPGGSLRLSCAASGFTFSDYYMSWIRQAPGKGLEWVSFISGSGSIIYYADSVK GRFTISRDNAKNSLYLQMNSLRAEDTAVYYCARDGMVRGMNFYGMDVWGQGTTVTVSSASTKGPS VFPLAPSSKSTSGGTAALGCLVKDYFPEPVTVSWNSGALTSGVHTFPAVLQSSGLYSLSSVVTVP SSSLGTQTYICNVNHKPSNTKVDKRVEPKSCDKTHTCPPCPAPEAEGAPSVFLFPPKPKDTLMIS RTPEVTCVVVDVSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVMHEALHNHYTQKSLSLSPG* |
| 29 TIM3.5 (13A3), TIM3.2 (17C3), TIM3.4 (3G4), TIM3.25/23B3 (VK1) IgG1 Light Chain | EIVLTQSPGTLSLSPGERATLSCRASQSVSSSYLAWYQQKPGQAPRLLIYGASSRATGIPDRFSG SGSGTDFTLTISRLEPEDFAVYYCQQYGSSPITFGQGTRLEIKRTVAAPSVFIFPPSDEQLKSGT ASVVCLLNNFYPREAKVQWKVDNALQSGNSQESVTEQDSKDSTYSLSSTLTLSKADYEKHKVYAC EVTHQGLSSPVTKSFNRGEC* |
| 30 8B9, TIM3.6 (8C4), TIM3.9 (17C8) IgG1 Light Chain | EIVLTQSPGTLSLSPGERATLSCRASQSVSSSYLAWYQQKPGQAPRLLIYGASSRATGIPDRFSG SGSGTDFTLTISRLEPEDFAVYYCQQYGSSPLTFGGGTKVEIKRTVAAPSVFIFPPSDEQLKSGT ASVVCLLNNFYPREAKVQWKVDNALQSGNSQESVTEQDSKDSTYSLSSTLTLSKADYEKHKVYAC EVTHQGLSSPVTKSENRGEC* |

TABLE 1-continued

| SEQ ID Description | Sequences |
|---|---|
| 329F6 VK1 IgG1 Light Chain | AIQLTQSPSSLSASVGDRVTITCRASQGISSALAWYQQKPGKAPKLLIYDASSLESGVPSRFSGS<br>GSGTDFTLTISSLQPEDFATYYCQQFNSYPRTFGQGTKVEIKRTVAAPSVFIFPPSDEQLKSGTA<br>SVVCLLNNFYPREAKVQWKVDNALQSGNSQESVTEQDSKDSTYSLSSTLTLSKADYEKHKVYACE<br>VTHQGLSSPVTKSFNRGEC* |
| 339F6 VK2 IgG1 Light Chain | EIVLTQSPGTLSLSPGERATLSCRASQSVSSSYLAWYQQKPGQAPRLLIYGASSRATGIPDRFSG<br>SGSGTDFTLTISRLEPEDFAVYYCQQYGSSLTFGGGTKVEIKRTVAAPSVFIFPPSDEQLKSGTA<br>SVVCLLNNFYPREAKVQWKVDNALQSGNSQESVTEQDSKDSTYSLSSTLTLSKADYEKHKVYACE<br>VTHQGLSSPVTKSFNRGEC* |
| 319F6 VK3 IgG1 Light Chain | EIVLTQSPGTLSLSPGERATLSCRASQSVSSSYLAWYQQKPGQAPRLLIYGASSRATGIPDRFSG<br>SGSGTDFTLTISRLEPEDFAVYYCQQYGSSPLTEGGGTKVEIKRTVAAPSVFIFPPSDEQLKSGT<br>ASVVCLLNNFYPREAKVQWKVDNALQSGNSQESVTEQDSKDSTYSLSSTLTLSKADYEKHKVYAC<br>EVTHQGLSSPVTKSENRGEC* |
| 408TIM3.24/14H7 IgG1 Light Chain | EIVLTQSPGTLSLSPGERATLSCRASQSVSSSYLAWYQQKPGQAPRLLIYGASSRATGIPDRFSG<br>SGSGTDFTLTISRLEPEDFAVYYCQQYGSSPLTFGPGTKVDIKRTVAAPSVFIEPPSDEQLKSGT<br>ASVVCLLNNFYPREAKVQWKVDNALQSGNSQESVTEQDSKDSTYSLSSTLTLSKADYEKHKVYAC<br>EVTHQGLSSPVTKSFNRGEC* |
| 40923B3 IgG1 Light Chain (VK2) | EIVLTQSPGTLSLSPGERATLSCRASQSVSSSYLAWYQQKPGQAPRLLIYGASSRATGIPDRFSG<br>SGSGTDFTLTISRLEPEDFAVYYCQQYGSSPEGGGTKVEIKRTVAAPSVFIFPPSDEQLKSGTAS<br>VVCLLNNEYPREAKVQWKVDNALQSGNSQESVTEQDSKDSTYSLSSTLTLSKADYEKHKVYACEV<br>THQGLSSPVTKSFNRGEC |
| 451TIM3.20 IgG1f Heavy Chain | QLQLQESGPGLVKPSETLSLTCTVSGDSINSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPELLGGPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPGK |
| 452TIM3.20 IgG1.3f Heavy Chain | QLQLQESGPGLVKPSETLSLTCTVSGDSINSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPEAEGAPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPGK |
| 454TIM3.21 IgG1f Heavy Chain | QLQLQESGPGLVKPSETLSLTCTVSGDSINSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPELLGGPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPGK |
| 455TIM3.21 IgG1.3f Heavy Chain | QLQLQESGPGLVKPSETLSLTCTVSGDSINSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPEAEGAPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPGK |
| 457TIM3.22 IgG1f Heavy Chain | QLQLQESGPGLVKPSETLSLTCTVSGDSISSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPELLGGPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPGK |
| 458TIM3.22 IgG1.3f Heavy Chain | QLQLQESGPGLVKPSETLSLTCTVSGDSISSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPEAEGAPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPGK |
| 459TIM3.23 IgG1f Heavy Chain | QLQLQESGPGLVKPSETLSLTCTVSGDSISSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPELLGGPSVFLFPPKPKDTLMISR |

TABLE 1-continued

| SEQ ID Description | Sequences |
|---|---|
| | TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPGK |
| 460 TIM3.23 IgG1.3f Heavy Chain | QLQLQESGPGLVKPSETLSLTCTVSGDSISSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPEAEGAPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPGK |
| 461 TIM3.20 IgG1f Heavy Chain (no C-terminal K) | QLQLQESGPGLVKPSETLSLTCTVSGDSINSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPELLGGPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPG |
| 462 TIM3.20 IgG1.3f Heavy Chain (no C-terminal K) | QLQLQESGPGLVKPSETLSLTCTVSGDSINSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPEAEGAPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPG |
| 463 TIM3.21 IgG1f Heavy Chain (no C-terminal K) | QLQLQESGPGLVKPSETLSLTCTVSGDSINSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPELLGGPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPG |
| 464 TIM3.21 IgG1.3f Heavy Chain (no C-terminal K) | QLQLQESGPGLVKPSETLSLTCTVSGDSINSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPEAEGAPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPG |
| 465 TIM3.22 IgG1f Heavy Chain (no C-terminal K) | QLQLQESGPGLVKPSETLSLTCTVSGDSISSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPELLGGPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPG |
| 466 TIM3.22 IgG1.3f Heavy Chain (no C-terminal K) | QLQLQESGPGLVKPSETLSLTCTVSGDSISSTNYYWDWIRQPPGKGLEWIGSMYYSGSPYYNPSL<br>RSPVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPEAEGAPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPG |
| 467 TIM3.23 IgG1f Heavy Chain (no C-terminal K) | QLQLQESGPGLVKPSETLSLTCTVSGDSISSTNYYWDWIRQPPGKGLEWIGSMYYSGSPYYNPSL<br>RSPVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPELLGGPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPG |
| 468 TIM3.23 IgG1.3f Heavy Chain (no C-terminal K) | QLQLQESGPGLVKPSETLSLTCTVSGDSISSTNYYWDWIRQPPGKGLEWIGSMYYSGSPYYNPSL<br>RSRVTISIDTSKNQFSLKLSSVTAADTAVYYCARHGGWTTVTWFDPWGQGTLVTVSSASTKGPSV<br>FPLAPSSKSTSGGTAALGCLVKDYFPEPVTVSWNSGALTSGVHTFPAVLQSSGLYSLSSVVTVPS<br>SSLGTQTYICNVNHKPSNTKVDKRVEPKSCDKTHTCPPCPAPEAEGAPSVFLFPPKPKDTLMISR<br>TPEVTCVVVDVSHEDPEVKFNWYVDGVEVHNAKTKPREEQYNSTYRVVSVLTVLHQDWLNGKEYK<br>CKVSNKALPAPIEKTISKAKGQPREPQVYTLPPSREEMTKNQVSLTCLVKGFYPSDIAVEWESNG<br>QPENNYKTTPPVLDSDGSFFLYSKLTVDKSRWQQGNVFSCSVMHEALHNHYTQKSLSLSPG |

TABLE 1-continued

| SEQ ID Description | Sequences |
|---|---|
| 134 TIM3.5 (13A3) IgG1.1f Heavy Chain | CAGCTGCAGCTGCAGGAGTCGGGCCOAGGACTGGTGAAGCCTTCGGAGACCCTCTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACAACCCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGGCCACT GGTTCGACCCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AAGCCGAAGGGGCCCCGTCAGTCTTCCTCTTCCCCCCAAAACCCAAGGACACCCTCATGATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAAGCAGCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGCGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTAAATGA |
| 135 8B9 IgG1.1f Heavy Chain | CAGGTGCAGCTGCAGGAGTCGGGCCOAGGACTGGTGAAGCCTTCGGAGACCCTGTCCCTCACCTG CACTGTCTCTGGTGGCTCCATCAGTCGTCACTACTGGAACTGGATCCGGCAGCCCCCAGGGAAGG GACTGGAGTGGATTGGGTATATCCATTACAGTGGAAGCACCAACTACAATTCCTCCCTCAAGAGT CGAGTCACCATATCAGTAGACACGTCCAAGAACCAGTTCTCCCTGAAGCTGAGCTCTGTGACCCC TCCCGACACGGCCGTGTATTACTGTGCGAGAGATACTGGGTACTACGGTATGGACATCTGGGGCC AAGGGACCACGGTCACCGTCTCCTCAGCTAGCACCAAGGGCCCATCGGTCTTCCCCCTGGCACCC TCCTCCAAGAGCACCTCTGGGGGCACAGCGGCCCTGGGCTGCCTGGTCAAGGACTACTTCCCCGA ACCGGTGACGGTGTCGTGGAACTCAGGCGCCCTGACCAGCGGCGTGCACACCTTCCCGGCTGTCC TACAGTCCTCAGGACTCTACTCCCTCAGCAGCGTGGTGACCGTGCCCTCCAGCAGCTTGGGCACC CAGACCTACATCTGCAACGTGAATCACAAGCCCAGCAACACCAAGGTGGACAAGAGAGTTGAGCC CAAATCTTGTGACAAAACTCACACATGCCCACCGTGCCCAGCACCTGAAGCCGAAGGGGCCCCGT CAGTCTTCCTCTTCCCCCCAAAACCCAAGGACACCCTCATGATCTCCCGGACCCCTGAGGTCACA TGCGTGGTGGTGGACGTGAGCCACGAAGACCCTGAGGTCAAGTTCAACTGGTACGTGGACGGCGT GGAGGTGCATAATGCCAAGACAAAGCCGCGGGAGGAGCAGTACAACAGCACGTACCGTGTGGTCA GCGTCCTCACCGTCCTGCACCAGGACTGGCTGAATGGCAAGGAGTACAAGTGCAAGGTCTCCAAC AAAGCCCTCCCAAGCAGCATCGAGAAAACCATCTCCAAAGCCAAAGGGCAGCCCCGAGAACCACA GGTGTACACCCTGCCCCCATCCCGGGAGGAGATGACCAAGAACCAGGTCAGCCTGACCTGCCTGG TCAAAGGCTTCTATCCCAGCGACATCCCCGTGGAGTGGGAGAGCAATGGGCAGCCGGAGAACAAC TACAAGACCACGCCTCCCGTGCTGGACTCCGACGGCTCCTTCTTCCTCTATAGCAAGCTCACCGT GGACAAGAGCAGGTGGCAGCAGGGGAACGTCTTCTCATGCTCCGTGATGCATGAGGCTCTGCACA ACCACTACACGCAGAAGAGCCTCTCCCTGTCCCCGGGTAAATGA |
| 136 TIM3.6 (8C4) IgG1.1f Heavy Chain | CAGGTGCAGCTGCAGGAGTCGGGCCCAGGACTGGTGAAGCCTTCGGAGACCCTCTCCCTCACCTG CACTGTCTCTGGTGGCTCCATCAGTCGTTACTACTGGAGCTGGATCCGGCAGCCCCCAGGGAAGG GACTGGAGTGGATTGGGTATATCCATTACACTGGGAGCACCAACTACAACCCCTCCCTCAAGAGT CGAGTCACCATATCAGTAGACACGTCCAAGAACCAGTTCTCCCTGAAGCTGAGCTCTGTGACCCC AGCGGACACGGCCGTGTATTACTGTGCGACAGATACGGGCTACTACGGTATGGACGTCTGGGGCC AAGGGACCACGGTCACCGTCTCCTCAGCTAGCACCAAGGGCCCATCGGTCTTCCCCCTGGCACCC TCCTCCAAGAGCACCTCTGGGGGCACAGCGGCCCTGGGCTGCCTGGTCAAGGACTACTTCCCCGA ACCGGTGACGGTGTCGTGGAACTCAGGCGCCCTGACCAGCGGCGTGCACACCTTCCCGGCTGTCC TACAGTCCTCAGGACTCTACTCCCTCAGCAGCGTGGTGACCGTGCCCTCCAGCAGCTTGGGCACC CAGACCTACATCTGCAACGTGAATCACAAGCCCAGCAACACCAAGGTGGACAAGAGAGTTGAGCC CAAATCTTGTGACAAAACTCACACATGCCCACCGTGCCCAGCACCTGAAGCCGAAGGGGCCCCGT CAGTCTTCCTCTTCCCCCCAAAACCCAAGGACACCCTCATGATCTCCCGGACCCCTGAGGTCACA TGCGTGGTGGTGGACGTGAGCCACGAAGACCCTGAGGTCAAGTTCAACTGGTACGTGGACGGCGT GGAGGTGCATAATGCCAAGACAAAGCCGCGGGAGGAGCAGTACAACAGCACGTACCGTGTGGTCA GCGTCCTCACCGTCCTGCACCAGGACTGGCTGAATGGCAAGGAGTACAAGTGCAAGGTCTCCAAC AAAGCCCTCCCAAGCAGCATCGAGAAAACCATCTCCAAAGCCAAAGGGCAGCCCCGAGAACCACA GGTGTACACCCTGCCCCCATCCCGGGAGGAGATGACCAAGAACCAGGTCAGCCTGACCTGCCTGG TCAAAGGCTTCTATCCCAGCGACATCGCCGTGGAGTGGGAGAGCAATGGGCAGCCGGAGAACAAC TACAAGACCACGCCTCCCGTGCTGGACTCCGACGGCTCCTTCTTCCTCTATAGCAAGCTCACCGT GGACAAGAGCAGGTGGCAGCAGGGGAACGTCTTCTCATGCTCCGTGATGCATGAGGCTCTGCACA ACCACTACACGCAGAAGAGCCTCTCCCTGTCCCCGGGTAAATGA |
| 137 TIM3.2 (17C3) IgG1.1f Heavy Chain | CAGGTGCAGTTGGTGCAGTCTGGGGCTGAGGTGAAGAAGCCTGGGGCCTCAGTGAAGGTCTCCTG CAAGGCATCTGGATACACTTTCACCAGCTACTATATGCACTGGGTGCGACAGGCCCCTGGACAAG GGCTTGAGTGGATGGGAATAATCAACCCTAGGGGTGATAGCTAATACTACGCACAGAAGTTCCAG GGCAGAGTCACCATGACCAGGGACACGTCCACGAGCACAGTCTACATGGAGCTGAGCAGCCTGAG ATCTGAGGACACGGCCGTGTATTACTGTGCGAGAGATTTCTATGGTTCGGGAAACTACTACTACG GTATGGACGTCTGGGGCCAAGGGACCACGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTCTTCCTCTTCCCCCCAAAACCCAAGGACACCCTCATGATCTCC<br>CGGACCCOTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 138 9F6 IgG1.1f Heavy Chain | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTGGTGGTAGTACCATATACTACGCAGACTCTGTGAAG<br>GGCCGATTCACCATCTCCAGGGACAACGCCAAGAACTCGCTGTTTCTGCAAATGAACAGCCTGAG<br>AGTCGAGGACACGGCTGTGTATTACTGTGCGAGAGATGGCTATAGCAGTGGCTGGTACTACTACG<br>GTATGGACGTCTGGGGCCAAGGGACCCGCGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 139 TIM3.4 (3G4) IgG1.1f Heavy Chain | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTACTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGAAGGGTATAGCAGCAGCTGGTCCTACTACT<br>ACGGTATGGACGTCTGGGGCCAAGGGACCACGGTCACCGTCTCCTCAGCTAGCACCAAGGGCCCA<br>TCGGTCTTCCCCCTGGCACCCTCCTCCAAGAGCACCTCTGGGGGCACAGCGGCCCTGGGCTGCCT<br>GGTCAAGGACTACTTCCCCGAACCGGTGACGGTGTCGTGGAACTCAGGCGCCCTGACCAGCGGCG<br>TGCACACCTTCCCGGCTGTCCTACAGTCCTCAGGACTCTACTCCCTCAGCAGCGTGGTGACCGTG<br>CCCTCCAGCAGCTTGGGCACCCAGACCTACATCTGCAACGTGAATCACAAGCCCAGCAACACCAA<br>GGTGGACAAGAGAGTTGAGCCCAAATCTTGTGACAAAACTCACACATGCCCACCGTGCCCAGCAC<br>CTGAAGCCGAAGGGGCCCCGTCAGTCTTCCTCTTCCCCCCAAAACCCAAGGACACCCTCATGATC<br>TCCCGGACCCCTGAGGTCACATGCGTGGTGGTGGACGTGAGCCACGAAGACCCTGAGGTCAAGTT<br>CAACTGGTACGTGGACGGCGTGGAGGTGCATAATGCCAAGACAAAGCCGCGGGAGGAGCAGTACA<br>ACAGCACGTACCGTGTGGTCAGCGTCCTCACCGTCCTGCACCAGGACTGGCTGAATGGCAAGGAG<br>TACAAGTGCAAGGTCTCCAACAAAGCCCTCCCAAGCAGCATCGAGAAAACCATCTCCAAAGCCAA<br>AGGGCAGCCCCGAGAACCACAGGTGTACACCCTGCCCCCATCCCGGGAGGAGATGACCAAGAACC<br>AGGTCAGCCTGACCTGCCTGGTCAAAGGCTTCTATCCCAGCGACATCGCCGTGGAGTGGGAGAGC<br>AATGGGCAGCCGGAGAACAACTACAAGACCACGCCTCCCGTGCTGGACTCCGACGGCTCCTTCTT<br>CCTCTATAGCAAGCTCACCGTGGACAAGAGCAGGTGGCAGCAGGGGAACGTCTTCTCATGCTCCG<br>TGATGCATGAGGCTCTGCACAACCACTACACGCAGAAGAGCCTCTCCCTGTCCCCGGGTAAATGA |
| 140 TIM3.9 (17C8) IgG1.1f Heavy Chain | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTAGTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGATGGGTATAGCAGTGGCTGGGAGTACTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |

TABLE 1-continued

| SEQ ID Description | Sequences |
|---|---|
| 141 TIM3.5 (13A3) IgG1.1f Heavy Chain (without C-terminal K) | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCAG GGAAGGGGCTGGAGTGGATTGGGAGTATCTATTATAGTGGGTTCACCTACTACAACCCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGGCCACT GGTTCGACCCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AAGCCGAAGGGGCCCCGTCAGTCTTCCTCTTCCCCCCAAAACCCAAGGACACCCTCATGATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAGCAGCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTTGA |
| 142 8B9 IgG1.1f Heavy Chain (without C-terminal K) | CAGGTGCAGCTGCAGGAGTCGGGCCCAGGACTGGTGAAGCCTTCGGAGACCCTGTCCCTCACCTG CACTGTCTCTGGTGGCTCCATCAGTCGTCACTACTGGAACTGGATCCGGCAGCCCCCAGGGAAGG GACTGGAGTGGATTGGGTATATCCATTACAGTGGAAGCACCAACTACAATTCCTCCCTCAAGAGT CGAGTCACCATATCAGTAGACACGTCCAAGAACCAGTTCTCCCTGAAGCTGAGCTCTGTGACCGC TGCGGACACGGCCGTGTATTACTGTGCGAGAGATACTGGGTACTACGGTATGGACATCTGGGGCC AAGGGACCACGGTCACCGTCTCCTCAGCTAGCACCAAGGGCCCATCGGTCTTCCCCCTGGCACCC TCCTCCAAGAGCACCTCTGGGGGCACAGCGGCCCTGGGCTGCCTGGTCAAGGACTACTTCCCCGA ACCGGTGACGGTGTCGTGGAACTCAGGCGCCCTGACCAGCGGCGTGCACACCTTCCCGGCTGTCC TACAGTCCTCAGGACTCTACTCCCTCAGCAGCGTGGTGACCGTGCCCTCCAGCAGCTTGGGCACC CAGACCTACATCTGCAACGTGAATCACAAGCCCAGCAACACCAAGGTGGACAAGAGAGTTGAGCC CAAATCTTGTGACAAAACTCACACATGCCCACCGTGCCCAGCACCTGAAGCCGAAGGGGCCCCGT CAGTCTTCCTCTTCCCCCCAAAACCCAAGGACACCCTCATGATCTCCCGGACCCCTGAGGTCACA TGCGTGGTGGTGGACGTGAGCCACGAAGACCCTGAGGTCAAGTTCAACTGGTACGTGGACGGCGT GGAGGTGCATAATGCCAAGACAAAGCCGCGGGAGGAGCAGTACAACAGCACGTACCGTGTGGTCA GCGTCCTCACCGTCCTGCACCAGGACTGGCTGAATGGCAAGGAGTACAAGTGCAAGGTCTCCAAC AAAGCCCTCCCAAGCAGCATCGAGAAAACCATCTCCAAAGCCAAAGGGCAGCCCCGAGAACCACA CGTCTACACCCTCCCCCCATCCCCCGACCACATGACCAPCJACCACCTCACCCTCCACCTCCGTC TCAAAGGCTTCTATCCCAGCGACATCGCCGTGGAGTGGGAGAGCAATGGGCAGCCGGAGAACAAC TACAAGACCACGCCTCCCGTGCTGGACTCCGACGGCTCCTTCTTCCTCTATAGCAAGCTCACCGT GGACAAGAGCAGGTGGCAGCAGGGGAACGTCTTCTCATGCTCCGTGATGCATGAGGCTCTGCACA ACCACTACACGCAGAAGAGCCTCTCCCTGTCCCCGGGTTGA |
| 143 TIM3.6 (8C4) IgG1.1f Heavy Chain (without C-terminal K) | CAGGTGCAGCTGCAGGAGTCGGGCCCAGGACTGGTGAAGCCTTCGGAGACCCTGTCCCTCACCTG CACTGTCTCTGGTGGCTCCATCAGTCGTTACTACTGGAGCTGGATCCGGCAGCCCCCAGGGAAGG GACTGGAGTGGATTGGGTATATCCATTACAGTGGGAGCACCAACTACAACCCCTCCCTCAAGAGT CGAGTCACCATATCAGTAGACACGTCCAAGAACCAGTTCTCCCTGAAGCTGAGCTCTGTGACCGC AGCGGACACGGCCGTGTATTACTGTGCGACAGATACGGGCTACTACGGTATGGACGTCTGGGGCC AAGGGACCACGGTCACCGTCTCCTCAGCTAGCACCAAGGGCCCATCGGTCTTCCCCCTGGCACCC TCCTCCAAGAGCACCTCTGGGGGCACAGCGGCCCTGGGCTGCCTGGTCAAGGACTACTTCCCCGA ACCGGTGACGGTGTCGTGGAACTCAGGCGCCCTGACCAGCGGCGTGCACACCTTCCCGGCTGTCC TACAGTCCTCAGGACTCTACTCCCTCAGCAGCGTGGTGACCGTGCCCTCCAGCAGCTTGGGCACC CAGACCTACATCTGCAACGTGAATCACAAGCCCAGCAACACCAAGGTGGACAAGAGAGTTGAGCC CAAATCTTGTGACAAAACTCACACATGCCCACCGTGCCCAGCACCTGAAGCCGAAGGGGCCCCGT CAGTCTTCCTCTTCCCCCCAAAACCCAAGGACACCCTCATGATCTCCCGGACCCCTGAGGTCACA TGCGTGGTGGTGGACGTGAGCCACGAAGACCCTGAGGTCAAGTTCAACTGGTACGTGGACGGCGT GGAGGTGCATAATGCCAAGACAAAGCCGCGGGAGGAGCAGTACAACAGCACGTACCGTGTGGTCA GCGTCCTCACCGTCCTGCACCAGGACTGGCTGAATGGCAAGGAGTACAAGTGCAAGGTCTCCAAC AAAGCCCTCCCAAGCAGCATCGAGAAAACCATCTCCAAAGCCAAAGGGCAGCCCCGAGAACCACA GGTGTACACCCTGCCCCCATCCCGGGAGGAGATGACCAAGAACCAGGTCAGCCTGACCTGCCTGG TCAAAGGCTTCTATCCCAGCGACATCGCCGTGGAGTGGGAGAGCAATGGGCAGCCGGAGAACAAC TACAAGACCACGCCTCCCGTGCTGGACTCCGACGGCTCCTTCTTCCTCTATAGCAAGCTCACCGT GGACAAGAGCAGGTGGCAGCAGGGGAACGTCTTCTCATGCTCCGTGATGCATGAGGCTCTGCACA ACCACTACACGCAGAAGAGCCTCTCCCTGTCCCCGGGTTGA |
| 144 TIM3.2 (17C3) IgG1.1f Heavy Chain (without C-terminal K) | CAGGTGCAGTTGGTGCAGTCTGGGGCTGAGGTGAAGAAGCCTGGGGCCTCAGTGAAGGTCTCCTG CAAGGCATCTGGATACACTTTCACCAGCTACTATATGCACTGGGTGCGACAGGCCCCTGGACAAG GGCTTGAGTGGATGGGAATAATCAACCCTAGGGGTGATAGCTATAATCTACGCACAGAAGTTCCAG GGCAGAGTCACCATGACCAGGGACACGTCCACGAGCACAGTCTACATGGAGCTGAGCAGCCTGAG ATCTCACCACACCCCCTCTATTACTCTCCCACACATTTCTATGCTTCCGCAPACTAOTACTACC GTATGGACGTCTGGGGCCAAGGGACCACGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 145 9F6 IgG1.1f Heavy Chain (without C-terminal K) | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTGGTGGTGGTAGTACCAGACTCTGTGAAG<br>GGCCGATTCACCATCTCCAGGGACAACGCCAAGAACTCGCTGTTTCTGCAAATGAACAGCCTGAG<br>ACTCCACCACACCCCTCTCTATTACTCTCCCACACATCCCTATACCACTCCCTCCTAGTACTACC<br>GTATGGACGTCTGGGGCCAAGGGACCGCGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 146 TIM3.4 (3G4) IgG1.1f Heavy Chain (without C-terminal K) | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTACTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGAAGGGTATAGCAGCAGCTGGTCCTACTACT<br>ACGGTATGGACGTCTGGGGCCAAGGGACCACGGTCACCGTCTCCTCAGCTAGCACCAAGGGCCCA<br>TCGGTCTTCCCCCTGGCACCCTCCTCCAAGAGCACCTCTGGGGGCACAGCGGCCCTGGGCTGCCT<br>GGTCAAGGACTACTTCCCCGAACCGGTGACGGTGTCGTGGAACTCAGGCGCCCTGACCAGCGGCG<br>TGCACACCTTCCCGGCTGTCCTACAGTCCTCAGGACTCTACTCCCTCAGCAGCGTGGTGACCGTG<br>CCCTCCAGCAGCTTGGGCACCCAGACCTACATCTGCAACGTGAATCACAAGCCCAGCAACACCAA<br>GGTGGACAAGAGAGTTGAGCCCAAATCTTGTGACAAAACTCACACATGCCCACCGTGCCCAGCAC<br>CTGAAGCCGAAGGGGCCCCGTCAGTCTTCCTCTTCCCCCCAAAACCCAAGGACACCCTCATGATC<br>TCCCGGACCCCTGAGGTCACATGCGTGGTGGTGGACGTGAGCCACGAAGACCCTGAGGTCAAGTT<br>CAACTGGTACGTGGACGGCGTGGAGGTGCATAATGCCAAGACAAAGCCGCGGGAGGAGCAGTACA<br>ACAGCACGTACCGTGTGGTCAGCGTCCTCACCGTCCTGCACCAGGACTGGCTGAATGGCAAGGAG<br>TACAAGTGCAAGGTCTCCAACAAAGCCCTCCCAAGCAGCATCGAGAAAACCATCTCCAAAGCCAA<br>AGCGCAGCCCCGAGAACCACAGGTCTACACCCTCCCCCATCCCGGGACCAGATGACCAAGAACC<br>AGGTCAGCCTGACCTGCCTGGTCAAAGGCTTCTATCCCAGCGACATCGCCGTGGAGTGGGAGAGC<br>AATGGGCAGCCGGAGAACAACTACAAGACCACGCCTCCCGTGCTGGACTCCGACGGCTCCTTCTT<br>CCTCTATAGCAAGCTCACCGTGGACAAGAGCAGGTGGCAGCAGGGGAACGTCTTCTCATGCTCCG<br>TGATGCATGAGGCTCTGCACAACCACTACACGCAGAAGAGCCTCTCCCTGTCCCCGGGTTGA |
| 147 TIM3.9 (17C8) IgG1.1f Heavy Chain (without C-terminal K) | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTAGTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGATGGGTATAGCAGTGGCTGGGAGTACTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCG3AGAACAAGTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |

TABLE 1-continued

| SEQ ID Description | Sequences |
|---|---|
| 148 TIM3.5 (13A3) IgG1.3f Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGGAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGGCCACT<br>GGTTCGACCCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 149 8B9 IgG1.3f Heavy Chain | AGGTGCAGCTGCAGGAGTCGGGCCCAGGACTGGTGAAGCCTTCGGAGACCCTGTCCCTCACCTGC<br>ACTGTCTCT3GTGGCTCCATCAGTCGTCACTACTGGAACTGGATCCGGCAGCCCCAGGGAAGGG<br>ACTGGAGTGGATTGGGTATATCCATTACAGTGGAAGCACCAACTACAATTCCTCCCTCAAGAGTC<br>GAGTCACCATATCAGTAGACACGTCCAAGAACCAGTTCTCCCTGAAGCTGAGCTCTGTGACCGCT<br>GCGGACACGGCCGTGTATTACTGTGCGAGAGATACTGGGTACTACGGTATGGACATCTGGGGCCA<br>AGGGACCACGGTCACCGTCTCCTCAGCTAGCACCAAGGGCCCATCGGTCTTCCCCCTGGCACCCT<br>CCTCCAAGAGCACCTCTGGGGGCACAGCGGCCCTGGGCTGCCTGGTCAAGGACTACTTCCCCGAA<br>CCGGTGACGGTGTCGTGGAACTCAGGCGCCCTGACCAGCGGCGTGCACACCTTCCCGGCTGTCCT<br>ACAGTCCTCAGGACTCTACTCCCTCAGCAGCGTGGTGACCGTGCCCTCCAGCAGCTTGGGCACCC<br>AGACCTACATCTGCAACGTGAATCACAAGCCCAGCAACACCAAGGTGGACAAGAGAGTTGAGCCC<br>AAATCTTGTGACAAAACTCACACATGCCCACCGTGCCCAGCACCTGAAGCCGAAGGGGCCCCGTC<br>AGTCTTCCTCTTCCCCCCAAAACCCAAGGACACCCTCATGATCTCCCGGACCCCTGAGGTCACAT<br>GCGTGGTGGTGGACGTGAGCCACGAAGACCCTGAGGTCAAGTTCAACTGGTACGTGGACGGCGTG<br>GAGGTGCATAATGCCAAGACAAAGCCGCGGGAGGAGCAGTACAACAGCACGTACCGTGTGGTGAG<br>CGTCCTCACCGTCCTGCACCAGGACTGGCTGAATGGCAAGGAGTACAAGTGCAAGGTCTCCAACA<br>AAGCCCTCCCAGCCCCCATCGAGAAAACCATCTCCAAAGCCAAAGGGCAGCCCCGAGAACCACAG<br>GTGTACACCCTGCCCCCATCCCGGGAGGAGATGACCAAGAACCAGGTCAGCCTGACCTGCCTGGT<br>CAAAGGCTTCTATCCCAGCGACATCGCCGTGGAGTGGGAGAGCAATGGGCAGCCGGAGAACAACT<br>ACAAGACCACGCCTCCCGTGCTGGACTCCGACGGCTCCTTCTTCCTCTATAGCAAGCTCACCGTG<br>GACAAGAGCAGGTGGCAGCAGGGGAACGTCTTCTCATGCTCCGTGATGCATGAGGCTCTGCACAA<br>CCACTACACGCAGAAGAGCCTCTCCCTGTCCCCGGGTAAATGA |
| 150 TIM3.6 (8C4) IgG1.3f Heavy Chain | CAGGTGCAGCTGCAGGAGTCGGGCCCAGGACTGGTGAAGCCTTCGGAGACCCTGTCCCTCACCTG<br>CACTGTCTCTGGTGGCTCCATCAGTCGTTACTACTGGAGCTGGATCCGGCAGCCCCCAGGGAAGG<br>GACTGGAGTGGATTGGGTATATCCATTACACTGGGAGCACCAACTACAACCCCTCCCTCAAGAGT<br>CGAGTCACCATATCAGTAGACACGTCCAAGAACCAGTTCTCCCTGAAGCTGAGCTCTGTGACCGC<br>AGCGGACACGGCCGTGTATTACTGTGCGACAGATACGGGCTACTACGGTATGGACGTCTGGGGCC<br>AAGGGACCACGGTCACCGTCTCCTCAGCTAGCACCAAGGGCCCATCGGTCTTCCCCCTGGCACCC<br>TCCTCCAAGAGCACCTCTGGGGGCACAGCGGCCCTGGGCTGCCTGGTCAAGGACTACTTCCCCGA<br>ACCGGTGACGGTGTCGTGGAACTCAGGCGCCCTGACCAGCGGCGTGCACACCTTCCCGGCTGTCC<br>TACAGTCCTCAGGACTCTACTCCCTCAGCAGCGTGGTGACCGTGCCCTCCAGCAGCTTGGGCACC<br>CAGACCTACATCTGCAACGTGAATCACAAGCCCAGCAACACCAAGGTGGACAAGAGAGTTGAGCC<br>CAAATCTTGTGACAAAACTCACACATGCCCACCGTGCCCAGCACCTGAAGCCGAAGGGGCCCCGT<br>CAGTCTTCCTCTTCCCCCCAAAACCCAAGGACACCCTCATGATCTCCCGGACCCCTGAGGTCACA<br>TGCGTGGTGGTGGACGTGAGCCACGAAGACCCTGAGGTCAAGTTCAACTGGTACGTGGACGGCGT<br>GGAGGTGCATAATGCCAAGACAAAGCCGCGGGAGGAGCAGTACAACAGCACGTACCGTGTGGTCA<br>GCGTCCTCACCGTCCTGCACCAGGACTGGCTGAATGGCAAGGAGTACAAGTGCAAGGTCTCCAAC<br>AAAGCCCTCCCAGCCCCCATCGAGAAAACCATCTCCAAAGCCAAAGGGCAGCCCCGAGAACCACA<br>GGTGTACACCCTGCCCCCATCCCGGGAGGAGATGACCAAGAACCAGGTCAGCCTGACCTGCCTGG<br>TCAAAGGCTTCTATCCCAGCGACATCGCCGTGGAGTGGGAGAGCAATGGGCAGCCGGAGAACAAC<br>TACAAGACCACGCCTCCCGTGCTGGACTCCGACGGCTCCTTCTTCCTCTATAGCAAGCTCACCGT<br>GGACAAGAGCAGGTGGCAGCAGGGGAACGTCTTCTCATGCTCCGTGATGCATGAGGCTCTGCACA<br>ACCACTACACGCAGAAGAGCCTCTCCCTGTCCCCGGGTAAATGA |
| 151 TIM3.2 (17C3) IgG1.3f Heavy Chain | CAGGTGCAGTTGGTGCAGTCTGGGGCTGAGGTGAAGAAGCCTGGGGCCTCAGTGAAGGTCTCCTG<br>CAAGGCATCTGGATACACTTTCACCAGCTACTATATGCACTGGGTGCGACAGGCCCCTGGACAAG<br>GGCTTGAGTGGATGGGAATAATCAACCCTAGGGGTGATAGCATAATCTACGCACAGAAGTTCCAG<br>GGCAGAGTCACCATGACCAGGGACACGTCCACGAGCACAGTCTACATGGAGCTGAGCAGCCTGAG<br>ATCTGAGGAOACGGCCGTGTATTACTGTGOGAGAGATTTCTATGGTTCGGGAAACTAOTACTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 152 9F6 IG1.3f Heavy Chain | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTGGTGGTAGTACCATATACTACGCAGACTCTGTGAAG<br>GGCCGATTCACCATCTCCAGGGACAACGCCAAGAACTCGCTGTTTCTGCAAATGAACAGCCTGAG<br>AGTCGAGGACACGGCTGTGTATTACTGTGCGAGAGATGGCTATAGCAGTGGCTGGTACTACTACG<br>GTATGGACGTCTGGGGCAAGGGACCGCGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCG3AGAACAAGTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 153 TIM3.4 (3G4) IgG1.3f Heavy Chain | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTACTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGAAGGGTATAGCAGCAGCTGGTCCTACTACT<br>ACGGTATGGACGTCTGGGGCCAAGGGACCACGGTCACCGTCTCCTCAGCTAGCACCAAGGGCCCA<br>TCGGTCTTCCCCCTGGCACCCTCCTCCAAGAGCACCTCTGGGGGCACAGCGGCCCTGGGCTGCCT<br>GGTCAAGGACTACTTCCCCGAACCGGTGACGGTGTCGTGGAACTCAGGCGCCCTGACCAGCGGCG<br>TGCACACCTTCCCGGCTGTCCTACAGTCCTCAGGACTCTACTCCCTCAGCAGCGTGGTGACCGTG<br>CCCTCCAGCAGCTTGGGCACCCAGACCTACATCTGCAACGTGAATCACAAGCCCAGCAACACCAA<br>GGTGGACAAGAGAGTTGAGCCCAAATCTTGTGACAAAACTCACACATGCCCACCGTGCCCAGCAC<br>CTGAAGCCGAAGGGGCCCCGTCAGTCTTCCTCTTCCCCCCAAAACCCAAGGACACCCTCATGATC<br>TCCCGGACCCCTGAGGTCACATGCGTGGTGGTGGACGTGAGCCACGAAGACCCTGAGGTCAAGTT<br>CAACTGGTACGTGGACGGCGTGGAGGTGCATAATGCCAAGACAAAGCCGCGGGAGGAGCAGTACA<br>ACAGCACGTACCGTGTGGTCAGCGTCCTCACCGTCCTGCACCAGGACTGGCTGAATGGCAAGGAG<br>TACAAGTGCAAGGTCTCCAACAAAGCCCTCCCAGCCCCCATCGAGAAAACCATCTCCAAAGCCAA<br>AGGGCAGCCCCGAGAACCACAGGTGTACACCCTGCCCCATCCCGGGAGGAGATGACCAAGAACC<br>AGGTCAGCCTGACCTGCCTGGTCAAAGGCTTCTATCCCAGCGACATCGCCGTGGAGTGGGAGAGC<br>AATGGGCAGCCGGAGAACAACTACAAGACCACGCCTCCCGTGCTGGACTCCGACGGCTCCTTCTT<br>CCTCTATAGCAAGCTCACCGTGGACAAGAGCAGGTGGCAGCAGGGGAACGTCTTCTCATGCTCCG<br>TGATGCATGAGGCTCTGCACAACCACTACACGCAGAAGAGCCTCTCCCTGTCCCCGGGTAAATGA |
| 154 TIM3.9 (17C8) IgG1.3f Heavy Chain | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTAGTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>ACCCCACCACACCCCTCTCTATTACTCTCCACACATCCCTATACCACTCCCTCCCACTACTACC<br>GTATGGACGTCTGGGGCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |

TABLE 1-continued

| SEQ ID Description | Sequences |
|---|---|
| 155 TIM3.5 (13A3) IgG1.3f Heavy Chain (no C-terminal K) | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAAGCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGGTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 156 8B9 IgG1.3f Heavy Chain (no C-terminal K) | AGGTGCAGCTGCAGGAGTCGGGCCCAGGACTGGTGAAGCCTTCGGAGACCCTGTCCCTCACCTGC<br>ACTGTCTCTGGTGGCTCCATCAGTCGTCACTACTGGAACTGGATCCGGCAGCCCCAGGGAAGGG<br>ACTGGAGTGGATTGGGTATATCCATTACAGTGGAAGCACCAACTACAATTCCTCCCTCAAGAGTC<br>GAGTCACCATATCAGTAGACACGTCCAAGAACCAGTTCTCCCTGAAGCTGAGCTCTGTGACCGCT<br>GCGGACACGGCCGTGTATTACTGTGCGAGAGATACTGGGTACTACGGTATGGACATCTGGGGCCA<br>AGGGACCACGGTCACCGTCTCCTCAGCTAGCACCAAGGGCCCATCGGTCTTCCCCCTGGCACCCT<br>CCTCCAAGAGCACCTCTGGGGGCACAGCGGCCCTGGGCTGCCTGGTCAAGGACTACTTCCCCGAA<br>CCGGTGACGGTGTCGTGGAACTCAGGCGCCCTGACCAGCGGCGTGCACACCTTCCCGGCTGTCCT<br>ACAGTCCTCAGGACTCTACTCCCTCAGCAGCGTGGTGACCGTGCCCTCCAGCAGCTTGGGCACCC<br>AGACCTACATCTGCAACGTGAATCACAAGCCCAGCAACACCAAGGTGGACAAGAGAGTTGAGCCC<br>AAATCTTGTGACAAAACTCACACATGCCCACCGTGCCCAGCACCTGAAGCCGAAGGGGCCCCGTC<br>AGTCTTCCTCTTCCCCCCAAAACCCAAGGACACCCTCATGATCTCCCGGACCCCTGAGGTCACAT<br>GCGTGGTGGTGGACGTGAGCCACGAAGACCCTGAGGTCAAGTTCAACTGGTACGTGGACGGCGTG<br>GAGGTGCATAATGCCAAGACAAAGCCGCGGGAGGAGCAGTACAACAGCACGTACCGTGTGGTCAG<br>CGTCCTCACCGTCCTGCACCAGGACTGGCTGAATGGCAAGGAGTACAAGTGCAAGGTCTCCAACA<br>AAGCCCTCCCAGCCCCCATCGAGAAAACCATCTCCAAAGCCAAAGGGCAGCCCCGAGAACCACAG<br>GTGTACACCCTGCCCCCATCCCGGGAGGAGATGACCAAGAACCAGGTCAGCCTGACCTGCCTGGT<br>CAAAGGCTTCTATCCCAGCGACATCGCCGTGGAGTGGGAGAGCAATGGGCAGCCGGAGAACAACT<br>ACAAGACCACGCCTCCCGTGCTGGACTCCGACGGCTCCTTCTTCCTCTATAGCAAGCTCACCGTG<br>GACAAGAGCAGGTGGCAGCAGGGGAACGTCTTCTCATGCTCCGTGATGCATGAGGCTCTGCACAA<br>CCACTACACGCAGAAGAGCCTCTCCCTGTCCCCGGGTTGA |
| 157 TIM3.6 (8C4) IgG1.3f Heavy Chain (no C-terminal K) | CAGGTGCAGCTGCAGGAGTCGGGCCCAGGACTGGTGAAGCCTTCGGAGACCCTGTCCCTCACCTG<br>CACTGTCTCTGGTGGCTCCATCAGTCGTTACTACTGGAGCTGGATCCGGCAGCCCCCAGGGAAGG<br>GACTGGAGTGGATTGGGTATATCCATTACAGTGGGAGCACCAACTACAACCCCTCCCTCAAGAGT<br>CGAGTCACCATATCAGTAGACACGTCCAAGAACCAGTTCTCCCTGAAGCTGAGCTCTGTGACCGC<br>AGCGGACACGGCCGTGTATTACTGTGCGACAGATACGGGCTACTACGGTATGGACGTCTGGGGCC<br>AACCCACCACCCTCACCCTCTCCTCACCTACCACCAACCCCCCATCCCTGTTCCCCCTCCCACCC<br>TCCTCCAAGAGCACCTCTGGGGGCACAGCGGCCCTGGGCTGCCTGGTCAAGGACTACTTCCCCGA<br>ACCGGTGACGGTGTCGTGGAACTCAGGCGCCCTGACCAGCGGCGTGCACACCTTCCCGGCTGTCC<br>TACAGTCCTCAGGACTCTACTCCCTCAGCAGCGTGGTGACCGTGCCCTCCAGCAGCTTGGGCACC<br>CAGACCTACATCTGCAACGTGAATCACAAGCCCAGCAACACCAAGGTGGACAAGAGAGTTGAGCC<br>CAAATCTTGTGACAAAACTCACACATGCCCACCGTGCCCAGCACCTGAAGCCGAAGGGGCCCCGT<br>CAGTCTTCCTCTTCCCCCCAAAACCCAAGGACACCCTCATGATCTCCCGGACCCCTGAGGTCACA<br>TGCGTGGTGGTGGACGTGAGCCACGAAGACCCTGAGGTCAAGTTCAACTGGTACGTGGACGGCGT<br>GGAGGTGCATAATGCCAAGACAAAGCCGCGGGAGGAGCAGTACAACAGCACGTACCGTGTGGTCA<br>GCGTCCTCACCGTCCTGCACCAGGACTGGCTGAATGGCAAGGAGTACAAGTGCAAGGTCTCCAAC<br>AAAGCCCTCCCAGCCCCCATCGAGAAAACCATCTCCAAAGCCAAAGGGCAGCCCCGAGAACCACA<br>GGTGTACACCCTGCCCCCATCCCGGGAGGAGAT3ACCAAGAACCAGGTCAGCCTGACCTGCCTGG<br>TCAAAGGCTTCTATCCCAGCGACATCGCCGTGGAGTGGGAGAGCAATGGGCAGCCGGAGAACAAC<br>TACAAGACCACGCCTCCCGTGCTGGACTCCGACGGCTCCTTCTTCCTCTATAGCAAGCTCACCGT<br>GGACAAGAGCAGGTGGCAGCAGGGGAACGTCTTCTCATGCTCCGTGATGCATGAGGCTCTGCACA<br>ACCACTACACGCAGAAGAGCCTCTCCCTGTCCCCGGGTTGA |
| 158 TIM3.2 (17C3) IgG1.3f Heavy Chain (no C-terminal K) | CAGGTGCAGTTGGTGCAGTCTGGGGCTGAGGTGAAGAAGCCTGGGGCCTCAGTGAAGGTCTCCTG<br>CAAGGCATCTGGATACACTTTCACCAGCTACTATATGCACTGGGTGCGACAGGCCCCTGGACAAG<br>GGCTTGAGTGGATGGGAATAATCAACCCTAGGGGTGATAGCATAATCTACGCACAGAAGTTCCAG<br>GGCAGAGTCACCATGACCAGGGACACGTCCACGAGCACAGTCTACATGGAGCTGAGCAGCCTGAG<br>ATCTGAGGACACGGCCGTGTATTACTGTGCGAGAGATTTCTATGGTTCGGGAAACTACTACTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCCTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 159 9F6 IgG1.3f Heavy Chain (no C-terminal K) | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTGGTGGTAGTACCATAACTACGCAGACTCTGTGAAG<br>GGCCGATTCACCATCTCCAGGGACAACGCCAAGAACTCGCTGTTTCTGCAAATGAACAGCCTGAG<br>AGTCCAGGACACCCCTCTCTATTACTCTCCGAGACATCGCTATACCAGTGGCTCGTACTACTACG<br>GTATGGACGTCTGGGGCCAAGGGACCGCGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGACAACAACTACAAGACCACGCCTCCCCTGCTGGACTCCGACCGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 160 TIM3.4 (3G4) IgG1.3f Heavy Chain (no C-terminal K) | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTACTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGAAGGGTATAGCAGCAGCTGGTCCTACTACT<br>ACGGTATGGACGTCTGGGGCCAAGGGACCACGGTCACCGTCTCCTCAGCTAGCACCAAGGGCCCA<br>TCGGTCTTCCCCCTGGCACCCTCCTCCAAGAGCACCTCTGGGGGCACAGCGGCCCTGGGCTGCCT<br>GGTCAAGGACTACTTCCCCGAACCGGTGACGGTGTCGTGGAACTCAGGCGCCCTGACCAGCGGCG<br>TGCACACCTTCCCGGCTGTCCTACAGTCCTCAGGACTCTACTCCCTCAGCAGCGTGGTGACCGTG<br>CCCTCCAGCAGCTTGGGCACCCAGACCTACATCTGCAACGTGAATCACAAGCCCAGCAACACCAA<br>GGTGGACAAGAGAGTTGAGCCCAAATCTTGTGACAAAACTCACACATGCCCACCGTGCCCAGCAC<br>CTGAAGCCGAAGGGGCCCCGTCAGTCTTCCTCTTCCCCCCAAAACCCAAGGACACCCTCATGATC<br>TCCCGGACCCCTGAGGTCACATGCGTGGTGGTGGACGTGAGCCACGAAGACCCTGAGGTCAAGTT<br>CAACTGGTACGTGGACGGCGTGGAGGTGCATAATGCCAAGACAAAGCCGCGGGAGGAGCAGTACA<br>ACAGCACGTACCGTGTGGTCAGCGTCCTCACCGTCCTGCACCAGGACTGGCTGAATGGCAAGGAG<br>TACAAGTGCAAGGTCTCCAACAAAGCCCTCCCAGCCCCCATCGAGAAAACCATCTCCAAAGCCAA<br>AGCGCACCCCCGACAACCACACCTCTACACCCTGCCCCCATCCCCCCACGAGATCACCAACAACC<br>AGGTCAGCCTGACCTGCCTGGTCAAAGGCTTCTATCCCAGCGACATCGCCGTGGAGTGGGAGAGC<br>AATGGGCAGCCGGAGAACAACTACAAGACCACGCCTCCCGTGCTGGACTCCGACGGCTCCTTCTT<br>CCTCTATAGCAAGCTCACCGTGGACAAGAGCAGGTGGCAGCAGGGGAACGTCTTCTCATGCTCCG<br>TGATGCATGAGGCTCTGCACAACCACTACACGCAGAAGAGCCTCTCCCTGTCCCCGGGTTGA |
| 161 TIM3.9 (17C8) IgG1.3f Heavy Chain (no C-terminal K) | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTAGTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGATGGGTATAGCAGTGGCTACTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATCATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |

TABLE 1-continued

| SEQ ID Description | Sequences |
| --- | --- |
| 205 TIM3.10 (13A3) IgG1.1f (N60Q) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACCAACCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 206 TIM3.11 (13A3) IgG1.1f (N60S) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACTCACCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 207 TIM3.12 (13A3) IgG1.1f (N60A) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACCACCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 208 TIM3.13 (13A3) IgG1.1f (D101E) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGAACCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 209 TIM3.14 (13A3) IgG1.1f (P102V) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACGTATGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 210 TIM3.15 (13A3) IgG1.1f (P102Y) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACTACTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AACCCCAACGCCCCCCCTCACTCTTCCTCTTCCCCCCAAAACCCAACCACACCCTCATCATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 211 TIM3.16 (13A3) IgG1.1f (P102L) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGCCCTACGGTGACTACGCCCACT<br>GGTTCGACCTATGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTGTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |

TABLE 1-continued

| SEQ ID | Description | Sequences |
|---|---|---|
| 212 | TIM3.17 (13A3) IgG1.1f (N60Q/P102Y) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACCAACGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACTACTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 355 | TIM3.18 (13A3) IgG1.1f (N60Q/D101E) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACCAACGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGAACCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AACCCCAACGCCCCCCTCACTCTTCCTCTTCCCCCCAAAACCCAACCACACCCTCATCATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 213 | TIM3.8 (8B9) IgG1.1f (S61P) Heavy Chain | CAGGTGCAGCTGCAGGAGTCGGGCCCAGGACTGGTGAAGCCTTCGGAGACCCTGTCCCTCACCTG<br>CACTGTCTCTGGTGGCTCCATCAGTCGTCACTACTGGAACTGGATCCGGCAGCCCCCAGGGAAGG<br>GACTGGAGTGGATTGGGTATATCCATTACAGTGGAAGCACCAACTACAATCCCTCCAAGAGT<br>CGAGTCACCATATCAGTAGACACGTCCAAGAACCAGTTCTCCCTGAAGCTGAGCTCTGTGACCGC<br>TGCGGACACGGCCGTGTATTACTGTGCGAGAGATACTGGGTACTACGGTATGGACATCTGGGGCC<br>JACCCACCACCCTCACCCTCTCCTCACCTACCACCAACCCCCCATCCCTGTTCCCCCTCCCACCC<br>TCCTCCAAGAGCACCTCTGGGGGCACAGCGGCCCTGGGCTGCCTGGTCAAGGACTACTTCCCCGA<br>ACCGGTGACGGTGTCGTGGAACTCAGGCGCCCTGACCAGCGGCGTGCACACCTTCCCGGCTGTCC<br>TACAGTCCTCAGGACTCTACTCCCTCAGCAGCGTGGTGACCGTGCCCTCCAGCAGCTTGGGCACC<br>CAGACCTACATCTGCAACGTGAATCACAAGCCCAGCAACACCAAGGTGGACAAGAGAGTTGAGCC<br>CAAATCTTGTGACAAAACTCACACATGCCCACCGTGCCCAGCACCTGAAGCCGAAGGGGCCCCGT<br>CAGTCTTCCTCTTCCCCCCAAAACCCAAGGACACCCTCATGATCTCCCGGACCCCTGAGGTCACA<br>TGCGTGGTGGTGGACGTGAGCCACGAAGACCCTGAGGTCAAGTTCAACTGGTACGTGGACGGCGT<br>GGAGGTGCATAATGCCAAGACAAAGCCGCGGGAGGAGCAGTACAACAGCACGTACCGTGTGGTCA<br>GCGTCCTCACCGTCCTGCACCAGGACTGGCTGAATGGCAAGGAGTACAAGTGCAAGGTCTCCAAC<br>AAAGCCCTCCCAAGCAGCATCGAGAAAACCATCTCCAAAGCCAAAGGGCAGCCCCGAGAACCACA<br>GGTGTACACCCTGCCCCCATCCCGGGAGGAGATGACCAAGAACCAGGTCAGCCTGACCTGCCTGG<br>TCAAAGGCTTCTATCCCAGCGACATCGCCGTGGAGTGGGAGAGCAATGGGCAGCCGGAGAACAAC<br>TACAAGACCACGCCTCCCGTGCTGGACTCCGACGGCTCCTTCTTCCTCTATAGCAAGCTCACCGT<br>GGACAAGAGCAGGTGGCAGCAGGGGAACGTCTTCTCATGCTCCGTGATGCATGAGGCTCTGCACA<br>ACCACTACACGCAGAAGAGCCTCTCCCTGTCCCCGGGTAAATGA |
| 214 | TIM3.7 (9F6) IgG1.1f (A108T) Heavy Chain | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GGCTGGAGTGGGTTTCATTCATTAGTGGTGGTGGTAGTACCATATACTACGCAGACTCTGTGAAG<br>GGCCGATTCACCATCTCCAGGGACAACGCCAAGAACTCGCTGTTTCTGCAAATGAACAGCCTGAG<br>ACTCCACCACACCCCTCTCTATTACTCTCCCACACATCCCTATACCACTCCCTCCTACTACTACC<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 430 TIM3.24/14H7 IgG1.1f Heavy Chain | CAGGTGCACCTGGTGGAGTCTGGGGGAGGCTTGGTCAAGCCTGGAGGGTCCCTGAGACTCTCCTG<br>TACAGCCTTCAGTGACTACTACATGAGCTGGATCCGCCAGGCTCCAGGGAAGGGGCTGGAGTGGT<br>TATCATACATTAGTAATAGTGGTAGTATCATATACTACGCAGACTCTGTGAAGGGCCGATTCACC<br>ATCTCCAGGGACAACGCCAAGAACTCAGTGTATCTGCAAATGAACAGCCTGAGAGCCGAGGACAC<br>GGCTGTGTATTACTGTGCGAGAGGGCGAATTGGTTTTTTTGACTACTGGGGCCCGGGAACCCTGG<br>TCACCGTCTCCTCAGCTAGCACCAAGGGCCCATCGGTCTTCCCCCTGGCACCCTCCTCCAAGAGC<br>ACCTCTGGGGGCACAGCGGCCCTGGGCTGCCTGGTCAAGGACTACTTCCCCGAACCGGTGACGGT<br>GTCGTGGAACTCAGGCGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGCACCCAGACCTACATC<br>TGCAACGTGAATCACAAGCCCAGCAACACCAAGGTGGACAAGAGAGTTGAGCCCAAATCTTGTGA<br>CAAAACTCACACATGCCCACCGTGCCCAGCACCTGAAGCCGAAGGGGCCCCGTCAGTCTTCCTCT<br>TCCCCCCAAAACCCAAGGACACCCTCATGATCTCCCGGACCCCTGAGGTCACATGCGTGGTGGTG<br>GACGTGAGCCACGAAGACCCTGAGGTCAAGTTCAACTGGTACGTGGACGGCGTGGAGGTGCATAA<br>TGCCAAGACAAAGCCGCGGGAGGAGCAGTACAACAGCACGTACCGTGTGGTCAGCGTCCTCACCG<br>TCCTGCACCAGGACTGGCTGAATGGCAAGGAGTACAAGTGCAAGGTCTCCAACAAAGCCCTCCCA<br>AGCAGCATCGAGAAAACCATCTCCAAAGCCAAAGGGCAGCCCCGAGAACCACAGGTGTACACCCT<br>GCCCCCATCCCGGGAGGAGATGACCAAGAACCAGGTCAGCCTGACCTGCCTGGTCAAAGGCTTCT<br>ATCCCAGCGACATCGCCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCACCGTGGACAAGAGCAG<br>GTGGCAGCAGGGGAACGTCTTCTCATGCTCCGTGATGCATGAGGCTCTGCACAACCACTACACGC<br>AGAAGAGCCTCTCCCTGTCCCCGGGTAAATGA |
| 434 23B3 IgG1.1f Heavy Chain | CAGGTGCAGCTGGTGGAATCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GGCTGGAATGGGTTTCATTCATTAGTGGTAGTGGTAGTATCATATACTACGCAGACTCTGTGAAG<br>GGCCGATTCACCATCTCCAGGGACAACGCCAAGAACTCACTGGATCTGCAAATGAACAGCCTGAG<br>AGCCGAGGACACGGCTGTGTATTACTGTGCGAGAGACGGTATGGTTCGGGGAATGAACTTCTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 438 TIM3.25 (23B3) IgG1.1f (G6E, D79Y) Heavy Chain | CAGGTGCAGCTGGTGGAATCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GGCTGGAATGGGTTTCATTCATTAGTGGTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGACGGTATGGTTCGGGGAATGAACTTCTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |

TABLE 1-continued

| SEQ ID | Description | Sequences |
|---|---|---|
| 215 | TIM3.10 (13A3) IgG1.1f (N60Q) Heavy Chain (no C-terminal K) | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACCAACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGACCCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AACCCCAACGCCCCCCCTCACTCTTCCTCTTCCCCCCAAAACCCAACCACACCCTCATCATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAAGCAGCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTTGA |
| 216 | TIM3.11 (13A3) IgG1.1f (N60S) Heavy Chain (no C-terminal K) | CAGCTGCAGCTGCAGGAGTCGGGCCCAGGACTGGTGAAGCCTTCGGAGACCCTGTCCCTCACCTG CACTGTCTCTGGTGCCTCCATCAGCAGTAGAAGTTACTACTCCCGCTGGATCCGCCAGCCCCCAG GGAAGGGGCTGGAGTGGATTGGGAGTATCTATTATAGTGGGTTCACCTACTACTCACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGACCCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AAGCCGAAGGGGCCCCGTCAGTCTTCCTCTTCCCCCCAAAACCCAAGGACACCCTCATGATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAAGCAGCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTTGA |
| 217 | TIM3.12 (13A3) IgG1.1f (N60A) Heavy Chain (no C-terminal K) | CAGCTGCAGCTGCAGGAGTCGGGCCCAGGACTGGTGAAGCCTTCGGAGACCCTGTCCCTCACCTG CACTCTCTCTCCTGGCTCCATCAGCACTAGAAGTTACTACTCCCGCTGGATCCCCCAGCCCCCAG GGAAGGGGCTGGAGTGGATTGGGAGTATCTATTATAGTGGGTTCACCTACTACCACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGACCCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AAGCCGAAGGGGCCCCGTCAGTCTTCCTCTTCCCCCCAAAACCCAAGGACACCCTCATGATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAAGCAGCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCG3AGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTTGA |
| 218 | TIM3.13 (13A3) IgG1.1f (D101E) Heavy Chain (no C-terminal K) | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACAACCCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGAACCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 219 TIM3.14 (13A3) IgGE1.1f (P102V) Heavy Chain (no C-terminal K) | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGGCTGGATCCGCCAGCCCCCAG<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACGTATGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AACCCCAACGCGCCCCGTCAGTCTTCCTCTTCCCCCCAAAACCCAACCACACCCTCATCATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 220 TIM3.15 (13A3) IgG1.1f (P102Y) Heavy Chain (no C-terminal K) | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACTACTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 221 TIM3.16 (13A3) IgG1.1f (P102L) Heavy Chain (no C-terminal K) | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCTATGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |

TABLE 1-continued

| SEQ ID Description | Sequences |
|---|---|
| 222 TIM3.17 (13A3) IgG1.1f (N60Q/P102Y) Heavy Chain (no C-terminal K) | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACCAACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGACTACTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AAGCCGAACGGGCCCCCTCAGTCTTCCTCTTCCCCCCAAAACCCAAGGACACCCTCATGATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAAGCAGCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTTGA |
| 356 TIM3.18 (13A3) IgG1.1f (N60Q/D101E) Heavy Chain (no C-terminal K) | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACCAACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGAACCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AAGCCGAAGGGGCCCCGTCAGTCTTCCTCTTCCCCCCAAAACCCAAGGACACCCTCATGATCTCC CGGACCCCTGAGGTCACATGCGTGGTGGTGGACGTGAGCCACGAAGACCCTGAGGTCAAGTTCAA CTGGTACGTGGACGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAAGCAGCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTTGA |
| 223 TIM3.8 (8B9) IgG1.1f (S61P) Heavy Chain (no C-terminal K) | CAGGTGCAGCTGCAGGAGTCGGGCCCAGGACTGGTGAAGCCTTCGGAGACCCTGTCCCTCACCTG CACTGTCTCTGGTGGCTCCATCAGTCGTCACTACTGGAACTGGATCCGGCAGCCCCCAGGGAAGG GACTGGAGTGGATTGGGTATATCCATTACAGTGGAAGCACCAACTACAATCCCTCCCTCAAGAGT CGAGTCACCATATCAGTAGACACGTCCAAGAACCAGTTCTCCCTGAAGCTGAGCTCTGTGACCGC TGCGGACACGGCCGTGTATTACTGTGCGAGAGATACTGGGTACTACGGTATGGACATCTGGGGCC AAGGGACCACGGTCACCGTCTCCTCAGCTAGCACCAAGGGCCCATCGGTCTTCCCCCTGGCACCC TCCTCCAAGAGCACCTCTGGGGGCACAGCGGCCCTGGGCTGCCTGGTCAAGGACTACTTCCCCGA ACCGGTGACGGTGTCGTGGAACTCAGGCGCCCTGACCAGCGGCGTGCACACCTTCCCGGCTGTCC TACAGTCCTCAGGACTCTACTCCCTCAGCAGCGTGGTGACCGTGCCCTCCAGCAGCTTGGGCACC CAGACCTACATCTGCAACGTGAATCACAAGCCCAGCAACACCAAGGTGGACAAGAGAGTTGAGCC CAAATCTTGTGACAAAACTCACACATGCCCACCGTGCCCAGCACCTGAAGCCGAAGGGCCCCCGT CAGTCTTCCTCTTCCCCCCAAAACCCAAGGACACCCTCATGATCTCCCGGACCCCTGAGGTCACA TGCGTGGTGGTGGACGTGAGCCACGAAGACCCTGAGGTCAAGTTCAACTGGTACGTGGACGGCGT GGAGGTGCATAATGCCAAGACAAAGCCGCGGGAGGAGCAGTACAACAGCACGTACCGTGTGGTCA GCGTCCTCACCGTCCTGCACCAGGACTGGCTGAATGGCAAGGAGTACAAGTGCAAGGTCTCCAAC AAAGCCCTCCCAAGCAGCATCGAGAAAACCATCTCCAAAGCCAAAGGGCAGCCCCGAGAACCACA GGTGTACACCCTGCCCCCATCCCGGGAGGAGATGACCAAGAACCAGGTCAGCCTGACCTGCCTGG TCAAAGGCTTCTATCCCAGCGACATCGCCGTGGAGTGGGAGAGCAATGGGCAGCCGGAGAACAAC TACAAGACCACGCCTCCCGTGCTGGACTCCGACGGCTCCTTCTTCCTCTATAGCAAGCTCACCGT GGACAAGAGCAGGTGGCAGCAGGGGAACGTCTTCTCATGCTCCGTGATGCATGAGGCTCTGCACA ACCACTACACGCAGAAGAGCCTCTCCCTGTCCCGGGTTGA |
| 224 TIM3.7 (9F6) IgG1.1f (A108T) Heavy Chain no C-terminal K) | CAGGTGCAGCTGGTGGAGTCTGGGGGAGGCTTGGTCAAGCCTGGAGGGTCCCTGAGACTCTCCTG TGCAGCCTCTGGATTCACCTTCAGTGACTACTACATGAGCTGGATCCGCCAGGCTCCAGGGAAGG GGCTGGAGTGGGTTTCATTCATTAGTGGTGGTGGTAGTACCATATACTACGCAGACTCTGTGAAG GGCCGATTCACCATCTCCAGGGACAACGCCAAGAACTCGCTGTTTCTGCAAATGAACAGCCTGAG AGTCGAGGACACGGCTGTGTATTACTGTGCGAGAGATGGCTATAGCAGTGGCTGGTACTACTACG GTATGGACGTCTGGGGCCAAGGGACCACGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AACCCCAACGCGCCCCCTCACTCTTCCTCTTCCCCCAAAACCCAACCACACCCTCATCATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 431TIM3.24/14H7 IgG1.1f Heavy Chain (no C-terminal K) | CAGGTGCACCTGGTGGAGTCTGGGGGAGGCTTGGTCAAGCCTGGAGGGTCCCTGAGACTCTCCTG<br>TACAGCCTTCAGTGACTACTACATGAGCTGGATCCGCCAGGCTCCAGGGAAGGGGCTGGAGTGGT<br>TATCATACATTAGTAATAGTGGTAGTATCATATACTACGCAGACTCTGTGAAGGGCCGATTCACC<br>ATCTCCAGGGACAACGCCAAGAACTCAGTGTATCTGCAAATGAACAGCCTGAGAGCCGAGGACAC<br>GGCTGTGTATTACTGTGCGAGAGGGCGAATTGGTTTTTTTGACTACTGGGGCCCGGGAACCCTGG<br>TCACCGTCTCCTCAGCTAGCACCAAGGGCCCATCGGTCTTCCCCCTGGCACCCTCCTCCAAGAGC<br>ACCTCTGGGGGCACAGCGGCCCTGGGCTGCCTGGTCAAGGACTACTTCCCCGAACCGGTGACGGT<br>GTCGTGGAACTCAGGCGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGCACCCAGACCTACATC<br>TGCAACGTGAATCACAAGCCCAGCAACACCAAGGTGGACAAGAGAGTTGAGCCCAAATCTTGTGA<br>CAAAACTCACACATGCCCACCGTGCCCAGCACCTGAAGCCGAAGGGGCCCGTCAGTCTTCCTCT<br>TCCCCCCAAAACCCAAGGACACCCTCATGATCTCCCGGACCCCTGAGGTCACATGCGTGGTGGTG<br>GACGTGAGCCACGAAGACCCTGAGGTCAAGTTCAACTGGTACGTGGACGGCGTGGAGGTGCATAA<br>TGCCAAGACAAAGCCGCGGGAGGAGCAGTACAACAGCACGTACCGTGTGGTCAGCGTCCTCACCG<br>TCCTGCACCAGGACTGGCTGAATGGCAAGGAGTACAAGTGCAAGGTCTCCAACAAAGCCCTCCCA<br>AGCAGCATCGAGAAAACCATCTCCAAAGCCAAAGGGCAGCCCCGAGAACCACAGGTGTACACCCT<br>GCCCCCATCCCGGGAGGAGATGACCAAGAACCAGGTCAGCCTGACCTGCCTGGTCAAAGGCTTCT<br>ATCCCAGCGACATCGCCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCACCGTGGACAAGAGCAG<br>GTGGCAGCAGGGGAACGTCTTCTCATGCTCCGTGATGCATGAGGCTCTGCACAACCACTACACGC<br>AGAAGAGCCTCTCCCTGTCCCCGGGTTGA |
| 43523B3 IgG1.1f Heavy Chain (no C-terminal K) | CAGGTGCAGCTGGTGGGATCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GGCTGGAATGGGTTTCATTCATTAGTGGTAGTGGTAGTATCATATACTACGCAGACTCTGTGAAG<br>GGCCGATTCACCATCTCCAGGGACAACGCCAAGAACTCACTGGATCTGCAAATGAACAGCCTGAG<br>ACCCCACCACACCCCTCTCTATTACTCTCCCACACACCCTATCCTTCCCCCAATCAACTTCTACC<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 439TIM3.25 (23B3) IgG1.1f (G6E, D79Y) Heavy Chain (no C-terminal K) | CAGGTGCAGCTGGTGGAATCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GGCTGGAATGGGTTTCATTCATTAGTGGTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGACGGTTAGTTCGGGGAATGAACTTCTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>+ACCCCAACCCCCCCCTCACTCTTCCTCTTCCCCCAAAACCCAACCACACCCTCATCATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAAGCAGCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |

TABLE 1-continued

| SEQ ID Description | Sequences |
|---|---|
| 225 TIM3.10 (13A3) IgG1.3f (N60Q) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACCAACCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 226 TIM3.11 (13A3) IgG1.3f (N60S) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACTCACCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 227 TIM3.12 (13A3) IgG1.3f (N60A) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACGCACCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAACGGGCCCGTCACTCTTCCTCTTCCCCCCAAAACCCAACCACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 228 TIM3.13 (13A3) IgG1.3f (D101E) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGAACCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGSAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 229 TIM3.14 (13A3) IgG1.3f (P102V) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACT3GGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACGTATGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 230 TIM3.15 (13A3) IgG1.3f (P102Y) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACTACTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 231 TIM3.16 (13A3) IgG1.3f (P102L) Heavy Chain | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCTATGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCCGACAACAAGTACAAGACCACCCCTCCCCTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |

TABLE 1-continued

| SEQ ID Description | Sequences |
|---|---|
| 232 TIM3.17 (13A3) IgG1.3f (N60Q/P102Y) Heavy Chain | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACCAACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGACTACTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AAGCCGAAGGGGCCCCGTCAGTCTTCCTCTTCCCCCCAAAACCCAAGGACACCCTCATGATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAGCCCCCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTAAATGA |
| 357 TIM3.18 (13A3) IgG1.3f (N60Q/D101E) Heavy Chain | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACT3GGGCTGGATCCGCCAGCCCCCAG GGAAGGGGCTGGAGTGGATTGGGAGTATCTATTATAGTGGGTTCACCTACTACCAACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGAACCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AACCCCAACGCCCCCCTCACTCTTCCTCTTCCCCCCAAAACCCAACCACACCCTCATCATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAGCCCCCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTAAATGA |
| 233 TIM3.8 (8B9) IgG1.3f (S61P) Heavy Chain | CAGGTGCAGCTGCAGGAGTCGGGCCCAGGACTGGTGAAGCCTTCGGAGACCCTGTCCCTCACCTG CACTGTCTCTGGTGGCTCCATCAGTCGTCACTACTGGAACTGGATCCGGCAGCCCCCAGGGAAGG GACTGGAGTGGATTGGGTATATCCATTACAGTGGAAGCACCAACTACAATCCCTCCAAGAGT CGAGTCACCATATCAGTAGACACGTCCAAGAACCAGTTCTCCCTGAAGCTGAGCTCTGTGACCGC TGCGGACACGGCCGTGTATTACTGTGCGAGAGATACTGGGTACTACGGTATGGACATCTGGGGCC AAGGGACCACGGTCACCGTCTCCTCAGCTAGCACCAAGGGCCCATCGGTCTTCCCCCTGGCACCC TCCTCCAAGAGCACCTCTGGGGGCACAGCGGCCCTGGGCTGCCTGGTCAAGGACTACTTCCCCGA ACCGGTGACGGTGTCGTGGAACTCAGGCGCCCTGACCAGCGGCGTGCACACCTTCCCGGCTGTCC TACAGTCCTCAGGACTCTACTCCCTCAGCAGCGTGGTGACCGTGCCCTCCAGCAGCTTGGGCACC CAGACCTACATCTGCAACGTGAATCACAAGCCCAGCAACACCAAGGTGGACAAGAGAGTTGAGCC CAAATCTTGTGACAAAACTCACACATGCCCACCGTGCCCAGCACCTGAAGCCGAAGGGGCCCCGT CAGTCTTCCTCTTCCCCCCAAAACCCAAGGACACCCTCATGATCTCCCGGACCCCTGAGGTCACA TGCGTGGTGGTGGACGTGAGCCACGAAGACCCTGAGGTCAAGTTCAACTGGTACGTGGACGGCGT GGAGGTGCATAATGCCAAGACAAAGCCGCGGGAGGAGCAGTACAACAGCACGTACCGTGTGGTCA GCGTCCTCACCGTCCTGCACCAGGACTGGCTGAATGGCAAGGAGTACAAGTGCAAGGTCTCCAAC AAAGCCCTCCCAGCCCCCATCGAGAAAACCATCTCCAAAGCCAAAGGGCAGCCCCGAGAACCACA GGTGTACACCCTGCCCCCATCCCGGGAGGAGATGACCAAGAACCAGGTCAGCCTGACCTGCCTGG TCAAAGGCTTCTATCCCAGCGACATCGCCGTGGAGTGGGAGAGCAATGGGCAGCCGGAGAACAAC TACAAGACCACGCCTCCCGTGCTGGACTCCGACGGCTCCTTCTTCCTCTATAGCAAGCTCACCGT GGACAAGAGCAGGTGGCAGCAGGGGAACGTCTTCTCATGCTCCGTGATGCATGAGGCTCTGCACA ACCACTACACGCAGAAGAGCCTCTCCCTGTCCCGGGTAAATGA |
| 234 TIM3.7 (9F6) IgG1.3f (A108T) Heavy Chain | CAGGTGCAGCTGGTGGAGTCTGGGGGAGGCTTGGTCAAGCCTGGAGGGTCCCTGAGACTCTCCTG TGCAGCCTCTGGATTCACCTTCAGTGACTACTACATGAGCTGGATCCGCCAGGCTCCAGGGAAGG GGCTGGAGTGGGTTTCATTCATTAGTGGTGGTGGTAGTACCATATACTACGCAGACTCTGTGAAG GGCCGATTCACCATCTCCAGGGACAACGCCAAGAACTCGCTGTTTCTCCAAATGAACAGCCTGAG AGTCGAGGACACGGCTGTGTATTACTGTGCGAGAGATGGCTATAGCAGTGGCTGGTACTACTACG GTATGGACGTCTGGGGCCAAGGGACCACGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTGTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 432TIM3.24/14H7 IgG1.3f Heavy Chain | CAGGTGCACCTGGTGGAGTCTGGGGGAGGCTTGGTCAAGCCTGGAGGGTCCCTGAGACTCTCCTG<br>TACAGCCTTCAGTGACTACTACATGAGCTGGATCCGCCAGGCTCCAGGGAAGGGGCTGGAGTGGT<br>TATCATACATTAGTAATAGTGGTAGTATCATATACTACGCAGACTCTGTGAAGGGCCGATTCACC<br>ATCTCCAGGGACAACGCCAAGAACTCAGTGTATCTGCAAATGAACAGCCTGAGAGCCGAGGACAC<br>GGCTGTGTATTACTGTGCGAGAGGGCGAATTGGTTTTTTTGACTACTGGGGCCCGGGAACCCTGG<br>TCACCGTCTCCTCAGCTAGCACCAAGGGCCCATCGGTCTTCCCCCTGGCACCCTCCTCCAAGAGC<br>ACCTCTGGGGGCACAGCGGCCCTGGGCTGCCTGGTCAAGGACTACTTCCCCGAACCGGTGACGGT<br>GTCGTGGAACTCAGGCGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGCACCCAGACCTACATC<br>TGCAACGTGAATCACAAGCCCAGCAACACCAAGGTGGACAAGAGAGTTGAGCCCAAATCTTGTGA<br>CAAAACTCACACATGCCCACCGTGCCCAGCACCTGAAGCCAAAGGGGCCCGTCAGTCTTCCTCT<br>TCCCCCCAAAACCCAAGGACACCCTCATGATCTCCCGGACCCCTGAGGTCACATGCGTGGTGGTG<br>GACGTGAGCCACGAAGACCCTGAGGTCAAGTTCAACTGGTACGTGGACGGCGTGGAGGTGCATAA<br>TGCCAAGACAAAGCCGCGGGAGGAGCAGTACAACAGCACGTACCGTGTGGTCAGCGTCCTCACCG<br>TCCTGCACCAGGACTGGCTGAATGGCAAGGAGTACAAGTGCAAGGTCTCCAACAAAGCCCTCCCA<br>GCCCCCATCGAGAAAACCATCTCCAAAGCCAAAGGGCAGCCCCGAGAACCACAGGTGTACACCCT<br>GCCCCCATCCCGGGAGGAGATGACCAAGAACCAGGTCAGCCTGACCTGCCTGGTCAAAGGCTTCT<br>ATCCCAGCGACATCGCCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCACCGTGGACAAGAGCAG<br>GTGGCAGCAGGGGAACGTCTTCTCATGCTCCGTGATGCATGAGGCTCTGCACAACCACTACACGC<br>AGAAGAGCCTCTCCCTGTCCCCGGGTAAATGA |
| 43623B3 IgG1.3f Heavy Chain | CAGGTGCAGCTGGTGGGATCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GGCTGGAATGGGTTTCATTCATTAGTGGTAGTGGTAGTATCATATACTACGCAGACTCTGTGAAG<br>GGCCGATTCACCATCTCCAGGGACAACGCCAAGAACTCACTGGATCTGCAAATGAACAGCCTGAG<br>AGCCGAGGACACGGCTGTGTATTACTGTGCGAGAGACGGTATGGTTCGGGGAATGAACTTCTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |
| 440TIM3.25 (23B3) IgG1.3f (G6E, D79Y) Heavy Chain | CAGGTGCAGCTGGTGGAATCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GGCTGGAATGGGTTTCATTCATTAGTGGTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCACCACACACCCTCTCTATTACTCTCCCACACACCCTTCCCGCAATCAACTTCTACC<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTAAATGA |

TABLE 1-continued

| SEQ ID | Description | Sequences |
|---|---|---|
| 235 | TIM3.10 (13A3) IgG1.3f (N60Q) Heavy Chain (no C-terminal K) | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACCAACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGACCCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AACCCCAACGCCCCCCCTCACTCTTCCTCTTCCCCCCAAAACCCAACCACACCCTCATCATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAGCCCCCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTTGA |
| 236 | TIM3.11 (13A3) IgG1.3f (N60S) Heavy Chain (no C-terminal K) | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACTCACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGACCCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AAGCCGAAGGGGCCCGTCAGTCTTCCTCTTCCCCCCAAAACCCAAGGACACCCTCATGATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAGCCCCCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTTGA |
| 237 | TIM3.12 (13A3) IgG1.3f (N60A) Heavy Chain (no C-terminal K) | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACCACCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGACCCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG AAGCCGAAGGGGCCCCGTCAGTCTTCCTCTTCCCCCCAAAACCCAAGGACACCCTCATGATCTCC CGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACA GCACGTACCGTGTGGTCAGCGTCCTCACCGTCCTGCACCAGGACTGGCTGAATGGCAAGGAGTAC AAGTGCAAGGTCTCCAACAAAGCCCTCCCAGCCCCCATCGAGAAAACCATCTCCAAAGCCAAAGG GCAGCCCCGAGAACCACAGGTGTACACCCTGCCCCCATCCCGGGAGGAGATGACCAAGAACCAGG TCAGCCTGACCTGCCTGGTCAAAGGCTTCTATCCCAGCGACATCGCCGTGGAGTGGGAGAGCAAT GGGCAGCCGGAGAACAACTACAAGACCACGCCTCCCGTGCTGGACTCCGACGGCTCCTTCTTCCT CTATAGCAAGCTCACCGTGGACAAGAGCAGGTGGCAGCAGGGGAACGTCTTCTCATGCTCCGTGA TGCATGAGGCTCTGCACAACCACTACACGCAGAAGAGCCTCTCCCTGTCCCCGGGTTGA |
| 238 | TIM3.13 (13A3) IgG1.3f (D101E) Heavy Chain (no C-terminal K) | CAGCTGCAGCTGCAGGAGTCGGGCCCAGGACTGGTGAAGCCTTCGGAGACCCTGTCCCTCACCTG CACTGTCTCTGGTGGCTCCATCAGCAGTAGAAGTTACTACTGGGGCTGGATCCGCCAGCCCCCAG GGAAGGGGCTGGAGTGGATTGGGAGTATCTATTATAGTGGGTTCACCTACTACAACCCGTCCCTC AAGAGTCGAGTCACCATATCCGTTGACACGTCCAAGAACCAGTTCTCCCTGAAGCTGAGCTCTGT GACCGCCGCAGACACGGCTGTGTATTATTGTGCGACAGGGGGGCCCTACGGTGACTACGCCCACT GGTTCGAACCCTGGGGCCAGGGAACCCTGGTCACCGTCTCCTCAGCTAGCACCAAGGGCCCATCG GTCTTCCCCCTGGCACCCTCCTCCAAGAGCACCTCTGGGGGCACAGCGGCCCTGGGCTGCCTGGT CAAGGACTACTTCCCCGAACCGGTGACGGTGTCGTGGAACTCAGGCGCCCTGACCAGCGGCGTGC ACACCTTCCCGGCTGTCCTACAGTCCTCAGGACTCTACTCCCTCAGCAGCGTGGTGACCGTGCCC TCCAGCAGCTTGGGCACCCAGACCTACATCTGCAACGTGAATCACAAGCCCAGCAACACCAAGGT GGACAAGAGAGTTGAGCCCAAATCTTGTGACAAAACTCACACATGCCCACCGTGCCCAGCACCTG |

TABLE 1-continued

| SEQ ID Description | Sequences |
|---|---|
| | AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 239 TIM3.14 (13A3)<br>IgG1.3f (P102V)<br>Heavy Chain (no<br>C-terminal K) | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACGTATGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 240 TIM3.15 (13A3)<br>IgG1.3f (P102Y)<br>Heavy Chain (no<br>C-terminal K) | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACTACTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 241 TIM3.16 (13A3)<br>IgG1.3f (P102L)<br>Heavy Chain (no<br>C-terminal K) | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACAACCCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACCTATGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTGTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |

TABLE 1-continued

| SEQ ID Description | Sequences |
|---|---|
| 242 TIM3.17 (13A3) IgG1.3f (N60Q/P102Y) Heavy Chain (no C-terminal K) | CAGCTGCAGCTGCAGGAGTCGGGCCCAGGACTGGTGAAGCCTTCGGAGACCCTGTCCCTCACCTG<br>CACTGTCTCTGGTGCCTCCATCAGCACTAGAAGTTACTACTCCCGCTGGATCCGCCAGCCCCCAG<br>GGAAGGGGCTGGAGTGGATTGGGAGTATCTATTATAGTGGGTTCACCTACTACCAACCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGACTACTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 358 TIM3.18 (13A3) IgG1.3f (N60Q/D101E) Heavy Chain (no C-terminal K) | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACTGGGGCTGGATCCGCCAGCCCCCAG<br>GGAAGGGGCTGGAGTGGATTGGGAGTATCTATTATAGTGGGTTCACCTACTACCAACCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGAACCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 374 TIM3.18 (13A3) IgG1.3f (N60Q/D101E) (T168C) Heavy Chain (no C-terminal K) | CAGCTGCAGCTGCAGGAGTCGGGCCCAGGACTGGTGAAGCCTTCGGAGACCCTGTCCCTCACCTG<br>CACTGTCTCTGGTGGCTCCATCAGCAGTAGAAGTTACTACT3GGGCTGGATTCGCCAGCCCCCAG<br>GGAAGGGCTGGAGTGGATTGGGAGTATCTATTATAGTGGGTTCACCTACTACCAACCGTCCCTC<br>AAGAGTCGAGTCACCATATCCGTTGACACGTCCAAGAACCAGTTCTCCCTGAAGCTGAGCTCTGT<br>GACCGCCGCAGACACGGCTGTGTATTATTGTGCGACAGGGGGGCCCTACGGTGACTACGCCCACT<br>GGTTCGAACCCTGGGGCCAGGGAACCCTGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 243 TIM3.8 (8B9) IgG1.3f (S61P) Heavy Chain (no C-terminal K) | CAGGTGCAGCTGCAGGAGTCGGGCCCAGGACTGGTGAAGCCTTCGGAGACCCTGTCCCTCACCTG<br>CACTGTCTCTGGTGGCTCCATCAGTCGTACTACTGGAGTCTGGATCCGGCAGCCCCCAGGGAAGG<br>GACTGGAGTGGATTGGGTATATCCATTACAGTGGAAGCACCAACTACAATCCCTCCCTCAAGAGT<br>CGAGTCACCATATCAGTAGACACGTCCAAGAACCAGTTCTCCCTGAAGCTGAGCTCTGTGACCGC<br>TGCGGACACGGCCGTGTATTACTGTGCGAGAGATACTGGGTACTACGGTATGGACATCTGGGGCC<br>AAGGGACCACGGTCACCGTCTCCTCAGCTAGCACCAAGGGCCCATCGGTCTTCCCCCTGGCACCC<br>TCCTCCAAGAGCACCTCTGGGGGCACAGCGGCCCTGGGCTGCCTGGTCAAGGACTACTTCCCCGA<br>ACCGGTGACGGTGTCGTGGAACTCAGGCGCCCTGACCAGCGGCGTGCACACCTTCCCGGCTGTCC<br>TACAGTCCTCAGGACTCTACTCCCTCAGCAGCGTGGTGACCGTGCCCTCCAGCAGCTTGGGCACC<br>CAGACCTACATCTGCAACGTGAATCACAAGCCCAGCAACACCAAGGTGGACAAGAGAGTTGAGCC<br>CAAATCTTGTGACAAAACTCACACATGCCCACCGTGCCCAGCACCTGAAGCCGAAGGGGCCCCGT |

TABLE 1-continued

| SEQ ID Description | Sequences |
|---|---|
| | CAGTCTTCCTCTTCCCCCCAAAACCCAAGGACACCCTCATGATCTCCCGGACCCCTGAGGTCACA<br>TGCGTGGTGGTGGACGTGAGCCACGAAGACCCTGAGGTCAAGTTCAACTGGTACGTGGACGGCGT<br>GGAGGTGCATAATGCCAAGACAAAGCCGCGGGAGGAGCAGTACAACAGCACGTACCGTGTGGTCA<br>GCGTCCTCACCGTCCTGCACCAGGACTGGCTGAATGGCAAGGAGTACAAGTGCAAGGTCTCCAAC<br>AAAGCCCTCCCAGCCCCCATCGAGAAAACCATCTCCAAAGCCAAAGGGCAGCCCCGAGAACCACA<br>GGTGTACACCCTGCCCCCATCCCGGGAGGAGATGACCAAGAACCAGGTCAGCCTGACCTGCCTGG<br>TCAAAGGCTTCTATCCCAGCGACATCGCCGTGGAGTGGGAGAGCAATGGGCAGCCGGAGAACAAC<br>TACAAGACCACGCCTCCCGTGCTGGACTCCGACGGCTCCTTCTTCCTCTATAGCAAGCTCACCGT<br>GGACAAGAGCAGGTGGCAGCAGGGGAACGTCTTCTCATGCTCCGTGATGCATGAGGCTCTGCACA<br>ACCACTACACGCAGAAGAGCCTCTCCCTGTCCCCGGGTTGA |
| 244 TIM3.7 (9F6) IgG1.3f (A108T) Heavy Chain (no C-terminal K) | CAGGTGCAGCTGGTGGAGTCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAGTGGGTTTCATTCATTAGTGGTGGTGGTAGTACCATATACTACGCAGACTCTGTGAAG<br>GGCCGATTCACCATCTCCAGGGACAACGCCAAGAACTCGCTGTTTCTGCAAATGAACAGCCTGAG<br>ACTCCACCACACCCCTCTCTATTACTCTCCACACATCCCTATACCACTCCCTCCTACTACTACC<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 433 TIM3.24/14H7 IgG1.3f Heavy Chain (no C-terminal K) | CAGGTGCACCTGGTGGAGTCTGGGGGAGGCTTGGTCAAGCCTGGAGGGTCCCTGAGACTCTCCTG<br>TACAGCCTTCAGTGACTACTACATGAGCTGGATCCGCCAGGCTCCAGGGAAGGGGCTGGAGTGGT<br>TATCATACATTAGTAATAGTGGTAGTATCATATACTACGCAGACTCTGTGAAGGGCCGATTCACC<br>ATCTCCAGGGACAACGCCAAGAACTCAGTGTATCTGCAAATGAACAGCCTGAGAGCCGAGGACAC<br>GGCTGTGTATTACTGTGCGAGAGGGCGAATTGGTTTTTTTGACTACTGGGGCCCGGGAACCCTGG<br>TCACCGTCTCCTCAGCTAGCACCAAGGGCCCATCGGTCTTCCCCCTGGCACCCTCCTCCAAGAGC<br>ACCTCTGGGGGCACAGCGGCCCTGGGCTGCCTGGTCAAGGACTACTTCCCCGAACCGGTGACGGT<br>GTCGTGGAACTCAGGCGCCCTGACCAGCGGCGTGCACACCTTCCCGGCTGTCCTACAGTCCTCAG<br>GACTCTACTCCCTCAGCAGCGTGGTGACCGTGCCCTCCAGCAGCTTGGGCACCCAGACCTACATC<br>TGCAACGTGAATCACAAGCCCAGCAACACCAAGGTGGACAAGAGAGTTGAGCCCAAATCTTGTGA<br>CAAAACTCACACATGCCCACCGTGCCCAGCACCTGAAGCCGAAGGGGCCCCGTCAGTCTTCCTCT<br>TCCCCCCAAAACCCAAGGACACCCTCATGATCTCCCGGACCCCTGAGGTCACATGCGTGGTGGTG<br>GACGTGAGCCACGAAGACCCTGAGGTCAAGTTCAACTGGTACGTGGACGGCGTGGAGGTGCATAA<br>TGCCAAGACAAAGCCGCGGGAGGAGCAGTACAACAGCACGTACCGTGTGGTCAGCGTCCTCACCG<br>TCCTGCACCAGGACTGGCTGAATGGCAAGGAGTACAAGTGCAAGGTCTCCAACAAAGCCCTCCCA<br>GCCCCCATCGAGAAAACCATCTCCAAAGCCAAAGGGCAGCCCCGAGAACCACAGGTGTACACCCT<br>GCCCCCATCCCGGGAGGAGATGACCAAGAACCAGGTCAGCCTGACCTGCCTGGTCAAAGGCTTCT<br>ATCCCAGCGACATCGCCGTGGAGTGGGAGAGCAATGGGCAGCCGGAGAACAACTACAAGACCACG<br>CCTCCCGTGCTGGACTCCGACGGCTCCTTCTTCCTCTATAGCAAGCTCACCGTGGACAAGAGCAG<br>GTGGCAGCAGGGGAACGTCTTCTCATGCTCCGTGATGCATGAGGCTCTGCACAACCACTACACGC<br>AGAAGAGCCTCTCCCTGTCCCCGGGTTGA |
| 437 23B3 IgG1.3f Heavy Chain (no C-terminal K) | CAGGTGCAGCTGGTGGGATCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GCTGGAATGGGTTTCATTCATTAGTGGTAGTGGTAGTATCATATACTACGCAGACTCTGTGAAG<br>GGCCGATTCACCATCTCCAGGGACAACGCCAAGAACTCACTGGATCTGCAAATGAACAGCCTGAG<br>AGCCGAGGACACGGCTGTGTATTACTGTGCGAGAGACGGTATGGTTCGGGGAATGAACTTCTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |

TABLE 1-continued

| SEQ ID | Description | Sequences |
|---|---|---|
| 441 | TIM3.25 (23B3) IgG1.3f (G6E, D79Y) Heavy Chain (no C-terminal K) | CAGGTGCAGCTGGTGGAATCTGGGGGAGGCTTGGTCAAGCCTGGAGGGTCCCTGAGACTCTCCTG<br>TGCAGCCTCTGGATTCACCTTCAGTGACTACTACATGAGCTGGATCCGCCAGGCTCCAGGGAAGG<br>GGCTGGAATGGGTTTCATTCATTAGTGGTAGTGGTAGTATCATATACTACGCAGACTCTGTGAAG<br>GGCCGATTCACCATCTCCAGGGACAACGCCAAGAACTCACTGTATCTGCAAATGAACAGCCTGAG<br>AGCCGAGGACACGGCTGTGTATTACTGTGCGAGAGACGGTATGGTTCGGGGAATGAACTTCTACG<br>GTATGGACGTCTGGGGCCAAGGGACCACGGTCACCGTCTCCTCAGCTAGCACCAAGGGCCCATCG<br>GTCTTCCCCCTGGCACCCTCCTCCAAGAGCACCTCTGGGGGCACAGCGGCCCTGGGCTGCCTGGT<br>CAAGGACTACTTCCCCGAACCGGTGACGGTGTCGTGGAACTCAGGCGCCCTGACCAGCGGCGTGC<br>ACACCTTCCCGGCTGTCCTACAGTCCTCAGGACTCTACTCCCTCAGCAGCGTGGTGACCGTGCCC<br>TCCAGCAGCTTGGGCACCCAGACCTACATCTGCAACGTGAATCACAAGCCCAGCAACACCAAGGT<br>GGACAAGAGAGTTGAGCCCAAATCTTGTGACAAAACTCACACATGCCCACCGTGCCCAGCACCTG<br>AAGCCGAAGGGGCCCGTCAGTCTTCCTCTTCCCCCCAAAACCCAAGGACACCCTCATGATCTCC<br>CGGACCCCTGAGGTCACATGCGTGGTGGTGGACGTGAGCCACGAAGACCCTGAGGTCAAGTTCAA<br>CTGGTACGTGGACGGCGTGGAGGTGCATAATGCCAAGACAAAGCCGCGGGAGGAGCAGTACAACA<br>GCACGTACCGTGTGGTCAGCGTCCTCACCGTCCTGCACCAGGACTGGCTGAATGGCAAGGAGTAC<br>AAGTGCAAGGTCTCCAACAAAGCCCTCCCAGCCCCCATCGAGAAAACCATCTCCAAAGCCAAAGG<br>GCAGCCCCGAGAACCACAGGTGTACACCCTGCCCCCATCCCGGGAGGAGATGACCAAGAACCAGG<br>TCAGCCTGACCTGCCTGGTCAAAGGCTTCTATCCCAGCGACATCGCCGTGGAGTGGGAGAGCAAT<br>GGGCAGCCGGAGAACAACTACAAGACCACGCCTCCCGTGCTGGACTCCGACGGCTCCTTCTTCCT<br>CTATAGCAAGCTCACCGTGGACAAGAGCAGGTGGCAGCAGGGGAACGTCTTCTCATGCTCCGTGA<br>TGCATGAGGCTCTGCACAACCACTACACGCAGAAGAGCCTCTCCCTGTCCCCGGGTTGA |
| 162 | TIM3.5 (13A3), TIM3.2 (17C3), TIM3.4 (3G4), TIM3.25 IgG1 Light Chain | GAAATTGTGTTGACGCAGTCTCCAGGCACCCTGTCTTTGTCTCCAGGGGAAAGAGCCACCCTCTC<br>CTGCAGGGCCAGTCAGAGTGTTAGCAGCAGCTACTTAGCCTGGTACCAGCAGAAACCTGGCCAGG<br>CTCCCAGGCTCCTCATCTATGGTGCATCCAGCAGGGCCACTGGCATCCCAGACAGGTTCAGTGGC<br>AGTGGGTCTGGGACAGACTTCACTCTCACCATCAGCAGACTGGAGCCTGAAGATTTTGCAGTGTA<br>TTACTGTCAGCAGTATGGTAGCTCACCGATCACCTTCGGCCAAGGGACACGACTGGAGATTAAAC<br>GTACGGTGGCTGCACCATCTGTCTTCATCTTCCCGCCATCTGATGAGCAGTTGAAATCTGGAACT<br>GCCTCTGTTGTGTGCCTGCTGAATAACTTCTATCCCAGAGAGGCCAAAGTACAGTGGAAGGTGGA<br>TAACGCCCTCCAATCGGGTAACTCCCAGGAGAGTGTCACAGAGCAGGACAGCAAGGACAGCACCT<br>ACAGCCTCAGCAGCACCCTGACGCTGAGCAAAGCAGACTACGAGAAACACAAAGTCTACGCCTGC<br>GAAGTCACCCATCAGGGCCTGAGCTCGCCCGTCACAAAGAGCTTCAACAGGGGAGAGTGTTAG |
| 163 | 8B9, TIM3.6 (8C4 TIM3.9) (17C8) IgG1 Light Chain | GAAATTGTGTTGACGCAGTCTCCAGGCACCCTGTCTTTGTCTCCAGGGGAAAGAGCCACCCTCTC<br>CTGCAGGGCCAGTCAGAGTGTTAGCAGCAGCTACTTAGCCTGGTACCAGCAGAAACCTGGCCAGG<br>CTCCCAGGCTCCTCATCTATGGTGCATCCAGCAGGGCCACTGGCATCCCAGACAGGTTCAGTGGC<br>AGTGGGTCTGGGACAGACTTCACTCTCACCATCAGCAGACTGGAGCCTGAAGATTTTGCAGTGTA<br>TTACTGTCAGCAGTATGGTAGCTCACCTCTCACTTTCGGCGGAGGGACCAAGGTGGAGATCAAAC<br>GTACGGTGGCTGCACCATCTGTCTTCATCTTCCCGCCATCTGATGAGCAGTTGAAATCTGGAACT<br>GCCTCTGTTGTGTGCCTGCTGAATAACTTCTATCCCAGAGAGGCCAAAGTACAGTGGAAGGTGGA<br>TAACGCCCTCCAATCGGGTAACTCCCAGGAGAGTGTCACAGAGCAGGACAGCAAGGACAGCACCT<br>ACAGCCTCAGCAGCACCCTGACGCTGAGCAAAGCAGACTACGAGAAACACAAAGTCTACGCCTGC<br>GAAGTCACCCATCAGGGCCTGAGCTCGCCCGTCACAAAGAGCTTCAACAGGGGAGAGTGTTAG |
| 165 | 9F6 VK1 IgG1 Light Chain | GCCATCCAGTTGACCCAGTCTCCATCCTCCCTGTCTGCATCTGTAGGAGACAGAGTCACCATCAC<br>TTGCCGGGCAAGTCAGGGCATTAGCAGTGCTTTAGCCTGGTATCAGCAGAAACCAGGGAAAGCTC<br>CTAAGCTCCTGATCTATGATGCCTCCAGTTTGGAAAGTGGGGTCCCATCAAGGTTCAGCGGCAGT<br>GGATCTGGGACAGATTTCACTCTCACCATCAGCAGCCTGCAGCCTGAAGATTTTGCAACTTATTA<br>CTGTCAACAGTTTAATAGTTACCCTCGGACGTTCGGCCAAGGGACCAAGGTGGAAATCAAACGTA<br>CGGTGGCTGCACCATCTGTCTTCATCTTCCCGCCATCTGATGAGCAGTTGAAATCTGGAACTGCC<br>TCTGTTGTGTGCCTGCTGAATAACTTCTATCCCAGAGAGGCCAAAGTACAGTGGAAGGTGGATAA<br>CGCCCTCCAATCGGGTAACTCCCAGGAGAGTGTCACAGAGCAGGACAGCAAGGACAGCACCTACA<br>GCCTCAGCAGCACCCTGACGCTGAGCAAAGCAGACTACGAGAAACACAAAGTCTACGCCTGCGAA<br>GTCACCCATCAGGGCCTGAGCTCGCCCGTCACAAAGAGCTTCAACAGGGGAGAGTGTTAG |
| 166 | 9F6 VK2 IgG1 Light Chain | GAAATTGTGTTGACGCAGTCTCCAGGCACCCTGTCTTTGTCTCCAGGGGAAAGAGCCACCCTCTC<br>CTGCAGGGCCAGTCAGAGTGTTAGCAGCAGCTACTTAGCCTGGTACCAGCAGAAACCTGGCCAGG<br>CTCCCAGGCTCCTCATCTATGGTGCATCCAGCAGGGCCACTGGCATCCCAGACAGGTTCAGTGGC<br>AGTGGGTCTGGGACAGACTTCACTCTCACCATCAGCAGACTGGAGCCTGAAGATTTTGCAGTGTA<br>TTACTGTCAGCAGTATGGTAGCTCACTCACTTTCGGCGGAGGGACCAAGGTGGAGATCAAACGTA<br>CGGTGGCTGCACCATCTGTCTTCATCTTCCCGCCATCTGATGAGCAGTTGAAATCTGGAACTGCC<br>TCTGTTGTGTGCCTGCTGAATAACTTCTATCCCAGAGAGGCCAAAGTACAGTGGAAGGTGGATAA<br>CGCCCTCCAATCGGGTAACTCCCAGGAGAGTGTCACAGAGCAGGACAGCAAGGACAGCACCTACA<br>GCCTCAGCAGCACCCTGACGCTGAGCAAAGCAGACTACGAGAAACACAAAGTCTACGCCTGCGAA<br>GTCACCCATCAGGGCCTGAGCTCGCCCGTCACAAAGAGCTTCAACAGGGGAGAGTGTTAG |
| 164 | 9F6 VK3 IgG1 Light Chain | GAAATTGTGTTGACGCAGTCTCCAGGCACCCTGTCTTTGTCTCCAGGGGAAAGAGCCACCCTCTC<br>CTGCAGGGCCAGTCAGAGTGTTAGCAGCAGCTACTTAGCCTGGTACCAGCAGAAACCTGGCCAGG<br>CTCCCAGGCTCCTCATCTATGGTGCATCCAGCAGGGCCACTGGCATCCCAGACAGGTTCAGTGGC<br>AGTGGGTCTGGGACAGACTTCACTCTCACCATCAGCAGACTGGAGCCTGAAGATTTTGCAGTGTA<br>TTACTGTCAGCAGTATGGTAGCTCACCGCTCACTTTCGGCGGAGGGACCAAGGTGGAGATCAAAC<br>GTACGGTGGCTGCACCATCTGTCTTCATCTTCCCGCCATCTGATGAGCAGTTGAAATCTGGAACT<br>GCCTCTGTTGTGTGCCTGCTGAATAACTTCTATCCCAGAGAGGCCAAAGTACAGTGGAAGGTGGA<br>TAACGCCCTCCAATCGGGTAACTCCCAGGAGAGTGTCACAGAGCAGGACAGCAAGGACAGCACCT<br>ACAGCCTCAGCAGCACCCTGACGCTGAGCAAAGCAGACTACGAGAAACACAAAGTCTACGCCTGC<br>GAAGTCACCCATCAGGGCCTGAGCTCGCCCGTCACAAAGAGCTTCAACAGGGGAGAGTGTTAG |

TABLE 1-continued

| SEQ ID Description | Sequences |
|---|---|
| 442 TIM3.24 (14H7) IgG1 Light Chain | GAAATTGTGTTGACGCAGTCTCCAGGCACCCTGTCTTTGTCTCCAGGGGAAAGAGCCACCCTCTC CTGCAGGGCCAGTCAGAGTGTTAGCAGCAGCTACTTAGCCTGGTACCAGCAGAAACCTGGCCAGG CTCCCAGGCTCCTCATCTATGGTGCATCCAGCAGGGCCACTGGCATCCCAGACAGGTTCAGTGGC AGTGGGTCTGGGACAGACTTCACTCTCACCATCAGCAGACTGGAGCCTGAAGATTTTGCAGTGTA TTACTGTCAGCAGTATGGTAGCTCACCTCTCACTTTCGGCCCTGGGACCAAAGTGGATATCAAAC GAACTGTGGCTGCACCATCTGTCTTCATCTTCCCGCCATCTGATGAGCAGTTGAAATCTGGAACT GCCTCTGTTGTGTGCCTGCTGAATAACTTCTATCCCAGAGAGGCCAAAGTACAGTGGAAGGTGGA TAACGCCCTCCAATCGGGTAACTCCCAGGAGAGTGTCACAGAGCAGGACAGCAAGGACAGCACCT ACAGCCTCAGCAGCACCCTGACGCTGAGCAAAGCAGACTACGAGAAACACAAAGTCTACGCCTGC GAAGTCACCCATCAGGGCCTGAGCTCGCCCGTCACAAAGAGCTTCAACAGGGGAGAGTGT |
| 443 23B3 IgG1 Light Chain (VK1) | GAAATTGTGTTGACGCAGTCTCCAGGCACCCTGTCTTTGTCTCCAGGGGAAAGAGCCACCCTCTC CTGCAGGGCCAGTCAGAGTGTTAGCAGCAGCTACTTAGCCTGGTACCAGCAGAAACCTGGCCAGG CTCCCAGGCTCCTCATCTATGGTGCATCCAGCAGGGCCACTGGCATCCCAGACAGGTTCAGTGGC AGTGGGTCTGGGACAGACTTCACTCTCACCATCAGCAGACTGGAGCCTGAAGATTTTGCAGTGTA TTACTGTCAGCAGTATGGTAGCTCACCGATCACCTTCGGCCAAGGGACACGACTGGAGATTAAAC GAACTGTGGCTGCACCATCTGTCTTCATCTTCCCGCCATCTGATGAGCAGTTGAAATCTGGAACT GCCTCTGTTGTGTGCCTGCTGAATAACTTCTATCCCAGAGAGGCCAAAGTACAGTGGAAGGTGGA TAACGCCCTCCAATCGGGTAACTCCCAGGAGAGTGTCACAGAGCAGGACAGCAAGGACAGCACCT ACAGCCTCAGCAGCACCCTGACGCTGAGCAAAGCAGACTACGAGAAACACAAAGTCTACGCCTGC GAAGTCACCCATCAGGGCCTGAGCTCGCCCGTCACAAAGAGCTTCAACAGGGGAGAGTGT |
| 444 23B3 IgG1 Light Chain (VK2) | GAAATTGTGTTGACGCAGTCTCCAGGCACCCTGTCTTTGTCTCCAGGGGAAAGAGCCACCCTCTC CTGCAGGGCCAGTCAGAGTGTTAGCAGCAGCTACTTAGCCTGGTACCAGCAGAAACCTGGCCAGG CTCCCAGGCTCCTCATCTATGGTGCATCCAGCAGGGCCACTGGCATCCCAGACAGGTTCAGTGGC AGTGGGTCTGGGACAGACTTCACTCTCACCATCAGCAGACTGGAGCCTGAAGATTTTGCAGTGTA TTACTGTCAGCAGTATGGTAGCTCACCTTTCGGCGGAGGGACCAAGGTGGAGATCAAACGAACTG TGGCTGCACCATCTGTCTTCATCTTCCCGCCATCTGATGAGCAGTTGAAATCTGGAACTGCCTCT GTTGTGTGCCTGCTGAATAACTTCTATCCCAGAGAGGCCAAAGTACAGTGGAAGGTGGATAACGC CCTCCAATCGGGTAACTCCCAGGAGAGTGTCACAGAGCAGGACAGCAAGGACAGCACCTACAGCC TCAGCAGCACCCTGACGCTGAGCAAAGCAGACTACGAGAAACACAAAGTCTACGCCTGCGAAGTC ACCCATCAGGGCCTGAGCTCGCCCGTCACAAAGAGCTTCAACAGGGGAGAGTGT |

The practice of the present disclosure will employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Sambrook et al., ed. (1989) Molecular Cloning A Laboratory Manual (2nd ed.; Cold Spring Harbor Laboratory Press); Sambrook et al., ed. (1992) Molecular Cloning: A Laboratory Manual, (Cold Springs Harbor Laboratory, NY); D. N. Glover ed., (1985) DNA Cloning, Volumes I and II; Gait, ed. (1984) Oligonucleotide Synthesis; Mullis et al. U.S. Pat. No. 4,683,195; Hames and Higgins, eds. (1984) Nucleic Acid Hybridization; Hames and Higgins, eds. (1984) Transcription And Translation; Freshney (1987) Culture Of Animal Cells (Alan R. Liss, Inc.); Immobilized Cells And Enzymes (IRL Press) (1986); Perbal (1984) A Practical Guide To Molecular Cloning; the treatise, Methods In Enzymology (Academic Press, Inc., N.Y.); Miller and Calos eds. (1987) Gene Transfer Vectors For Mammalian Cells, (Cold Spring Harbor Laboratory); Wu et al., eds., Methods In Enzymology, Vols. 154 and 155; Mayer and Walker, eds. (1987) Immunochemical Methods In Cell And Molecular Biology (Academic Press, London); Weir and Blackwell, eds., (1986) Handbook Of Experimental Immunology, Volumes I-IV; Manipulating the Mouse Embryo, Cold Spring Harbor Laboratory Press, Cold Spring Harbor, N.Y., (1986); Crooks, Antisense drug Technology: Principles, strategies and applications, 2$^{nd}$ Ed. CRC Press (2007) and in Ausubel et al. (1989) Current Protocols in Molecular Biology (John Wiley and Sons, Baltimore, Md.).

All of the references cited above, as well as all references cited herein, are incorporated herein by reference in their entireties.

The following examples are offered by way of illustration and not by way of limitation.

EXAMPLES

Example 1: Identification of Human Anti-TIM3 Antibodies

Human IgG transgenic (KM) mice were immunized with the plasma membrane fraction of HEK-293 human cells transfected with human TIM3. Lymph node cells from all immunized mice were fused to the SP210 fusion partner. Hybridoma supernatants were first screened for the presence of human IgG antibodies using a high throughput assay. Antigen specificity was then determined by FACS binding on human TIM3 transfected cells. Briefly, 47 fusions were performed, 3935 IgG positive clones were identified, of which 448 were identified as being positive for hTIM3 by ELISA, and of these 126 were found to be positive by hTIM3 FACS. Of these, 117 clones (or antibodies) were further analyzed by a variety of methods including: (1) epitope binning performed by Biacore; (2) TIM3 binding to a TIM3-transfected cell line (293-TIM3) to determine $EC_{50}$; (3) Th1 assays (as further described below); and (4) TIL assays (as further described below). Of the 117, nine hybridomas expressing fully human anti-human TIM3 antibodies were selected as having desirable characteristics: 13A3, 8B9, 8C4, 17C3, 9F6, 3G4, 17C8, 14H7 and 23B3. The amino acid of, and nucleotide sequences encoding, the variable domains of the antibodies produced by these hybridomas are provided in FIGS. 1A-9D, and the SEQ ID NOs of the CDRs, variable regions, and heavy and light chains as well as their isotype are provided in FIG. 16 (see rows with hybridoma names). A hydriboma and antibody secreted by it have the same name (e.g., 13A3).

Antibodies comprising the CDRs and/or variable domains of antibodies 13A3, 8B9, 8C4, 17C3, 9F6, 3G4, 17C8, 14H7, and 23B3 were also expressed recombinantly in host cells. Unless specified otherwise VK1 was used as the light chain for 23B3 and variants thereof (e.g., TIM3.25). Recombinant antibodies are referred to herein with the names "TIM3.2" to "TIM3.18," "TIM3.20," "TIM3.21," "TIM3.22," "TIM3.23," "TIM3.24," and "TIM3.25." When referring to any of these recombinant antibodies by their names "TIM3.2" to "TIM3.18," "TIM3.20," "TIM3.21," "TIM3.22," "TIM3.23," "TIM3.24," and "TIM3.25," no specific constant region is referred to, i.e., antibodies TIM3.2 to TIM3.18, TIM3.20, TIM3.21, TIM3.22, TIM3.23, TIM3.24, and TIM3.25 can have any desired constant region, e.g., those shown in FIG. 16.

CDRs and variable domains were expressed in the context of an effectorless IgG1 constant region (allotype "f"), which comprises the substitutions L234A, L235E, G237A, A330S and P331S ("IgG1.1f") and IgG1.3f, an effectorless IgG1 constant region (allotype "f"), which comprises substitutions L234A, L235E, G237A, i.e., it differs from IgG1.1f only in not having the A330S and P331S substitutions. The CDRs and variable regions can also be used in the context of IgG4, e.g., IgG4P (i.e., IgG4 with a "S228P" substitution). Certain CDRs and framework regions of these antibodies have also been mutated. Specifically, VH CDR2 of 13A3 and 8B9, VH CDR3 of 13A3, VH FR4 of 9F6, and VH FRI and FR3 of 23B3 have been mutated. A list of antibodies that have been produced or can be made is provided in FIG. 16, Table 1, and in the sequence listing. Antibodies expressed recombinantly include those described in the Examples below, as well as antibodies 3G4, 8C4, 9F6, 8B9, 17C8 that have been expressed as IgG1.1f antibodies.

A sequence alignment of the heavy and light chain variable regions of antibodies 13A3, 8B9, 8C4, 17C3, 9F6, 3G4, 17C8, 14H7, and 23B3 is provided in FIGS. 10A and 11A, respectively. The VH and VL region sequence designation are provided in FIGS. 10B and 11B, respectively. A sequence alignment of the wildtype and mutated 13A3 heavy chains is provided in FIG. 12. A sequence alignment of the wildtype and mutated 9F6 heavy chain is provided in FIG. 13. A sequence alignment of the wildtype and mutated 8B9 heavy chains is provided in FIG. 14. A sequence alignment of the wildtype and mutated 23B3 heavy chains is provided in FIG. 15.

Example 2: Characterization of the Human Anti-TIM3 Antibodies

The selected anti-TIM3 antibodies were assayed for binding to TIM3-expressing cells using flow cytometry. As shown in FIGS. 17A and 17B, anti-TIM3 antibodies 13A3, 17C3, 17C8, 3G4, 8B9, and 9F6 were able to bind to both CHO cells transfected with human TIM3 (FIG. 17A) and anti-CD3/anti-CD28-activated human T cells (FIG. 17B) with similar affinity. Anti-TIM3 antibody 8C4 also bound to activated human T cells (FIG. 17B). Similarly, anti-TIM3 antibodies 14H7 and 23B3 were also able to bind to activated human T cells (FIG. 18).

Anti-TIM3 antibodies were also tested for their ability to bind to cyno TIM3 transfected in CHO cells. As shown in FIG. 19A, anti-TIM3 antibodies 13A3, 17C3, and 3G4 were able to bind to cyno TIM3, whereas antibodies 9F6, 8B9, and 17C8 were not able to do so. Of these three antibodies that did bind to cyno TIM3, the 13A3 antibody did so with the strongest affinity (based on the $EC_{50}$ values provided).

As shown in FIG. 20, anti-TIM3 antibodies 14H7 and 23B3 were able to bind to CHO cells transfected with human or cyno TIM3.

To assess whether the anti-TIM3 antibodies bind to activated cyno $CD8^+$ T cells, cyno blood mononuclear cells (PBMCs) were stimulated with plate-bound anti-CD3 and soluble anti-CD28 for four days. Then, the relevant anti-TIM3 antibodies were added to the culture and binding to the activate cyno T cells was analyzed using flow cytometry. While several of the anti-TIM3 antibodies were able to bind to cyno TIM3 expressed on CHO cells (as described above), the 13A3, 14H7 and 23B3 antibodies were the only anti-TIM3 antibodies that were reactive with activated cyno T cells (FIGS. 19B and 19C).

Example 3: Binding Affinity of Anti-TIM3 Antibodies to Human and Cyno TIM3 as Determined by Surface Plasmon Resonance Kinetics and affinity of anti-TIM3 13A3 Fab fragments towards human and cyno TIM3 were determined on a Biacore T200 instrument at 37° C. in PBS pH 7.4 supplemented with 0.05% (v/v) Tween-20, as further described below. The human TIM3 protein used consisted of the extracellular domain (ECD) of human TIM3 linked to a mouse Fc, thereby forming a dimeric hTIM3 ECD-Fc protein ("hTIM3-mFc"). This fusion protein was expressed from stably transfected CHO cells, and purified out of the medium using protein A affinity, followed by size exclusion chromatography. The recombinant cynomolgus TIM3 protein used consisted of the extracellular domain of cynomolgus TIM3 followed by linker and affinity tags, thereby forming a monomeric cynoTIM3 ECD protein ("cyno TIM3-MycHisAvi"). This fusion protein was expressed from transiently transfected Expi293 cells (Life Tech) and the protein was isolated from the medium and purified out using affinity tag (6× His), followed by size exclusion chromatography.

The amino acid sequence of hTIM3-mFc was as follows:

(SEQ ID NO: 375)
SEVEYRAEVGQNAYLPCFYTPAAPGNLVPVCWGKGACPVFECGNVVLRT

DERDVNYWTSRYWLNGDFRKGDVSLTIENVTLADSGIYCCRIQIPGIMN

DEKFNLKLVIKPAKVTPAPTRQRDFTAAFPRMLTTRGHGPAETQTLGSL

PDINLTQISTLANELRDSRLANDLRDSGATIRIGASVPRDCGCKPCICT

VPEVSSVFIFPPKPKDVLTITLTPKVTCVVVAISKDDPEVQFSWFVDDV

EVHTAQTQPREEQFNSTFRSVSELPIMHQDWLNGKEFKCRVNSAAFPAP

IEKTISKTKGRPKAPQVYTIPPPKEQMAKDKVSLTCMITDFFPEDITVE

WQWNGQPAENYKNTQPIMDTDGSYFVYSKLNVQKSNWEAGNTFTCSVLH

EGLHNHHTEKSLSHSPGK

The amino acid sequence of cynoTIM3-MycHisAvi was as follows:

(SEQ ID NO: 376)
SEVEYRAEVGQNAYLPCFYTPAAPGNLVPVCWGKGACPVFECGNVVLRT

DERDVNYWTSRYWLNGDFRKGDVSLTIENVTLADSGIYCCRIQIPGIMN

DEKFNLKLVIKPAKSPGGGSGGGSEQKLISEEDLGHHHHHHGLNDIFEA

QKIEWHE

Fabs of 13A3 and TIM3.18.IgG1.3 linked to a histidine tail were used. The amino acid sequence of 13A3 Heavy Chain C Fab 6×His was as follows:

(SEQ ID NO: 365)
QLQLQESGPGLVKPSETLSLTCTVSGGSISSRSYYWGWIRQPPGKGLEW

IGSIYYSGFTYYNPSLKSRVTISVDTSKNQFSLKLSSVTAADTAVYYCA

TGGPYGDYAHWFDPWGQGTLVTVSSASTKGPSVFPLAPSSKSTSGGTAA

LGCLVKDYFPEPVTVSWNSGALTSGVHTFPAVLQSSGLYSLSSVVTVPS

SSLGTQTYICNVNHKPSNTKVDKRVEPKSCGGHHHHHH

The amino acid sequence of 13A3 Heavy Chain (HC) N60Q D101E Fab 6×His was as follows:

(SEQ ID NO: 366)
QLQLQESGPGLVKPSETLSLTCTVSGGSISSRSYYWGWIRQPPGKGLEW

IGSIYYSGFTYYQPSLKSRVTISVDTSKNQFSLKLSSVTAADTAVYYCA

TGGPYGDYAHWFEPWGQGTLVTVSSASTKGPSVFPLAPSSKSTSGGTAA

LGCLVKDYFPEPVTVSWNSGALTSGVHTFPAVLQSSGLYSLSSVVTVPS

SSLGTQTYICNVNHKPSNTKVDKRVEPKSCGGHHHHHH

Recombinant 13A3 and TIM3.18.IgG1.3 Fabs were made using transient transfection of Expi293 (Life Tech). The expressed Fab comprised the heavy chain variable region followed by the CH1 of hIgG1, and light chain variable region followed by the CL domain of hKappa. The expressed Fab was secreted into the medium and purified using affinity tag (6× His).

An anti-mouse antibody capture chip was prepared on a Biacore CM4 series S chip (GE Healthcare Life Sciences catalog #BR-1005-34) using the Biacore capture kit for mouse antibodies (catalog #BR-1008-38). Human TIM3-mouse Fc fusion protein was captured on flow cells 2 and 3 in two different surface densities. Cyno TIM3-mouse Fc fusion protein was captured on flow cell 4. Flow cell 1 (blank capture surface) served as a reference. Recombinantly expressed, His-tagged antibody Fab fragments were flowed as analytes over all surfaces in a 3-fold, 6-membered dilution series with 1.0 μM top concentration and 4.1 nM bottom concentration. Resulting sensorgrams were double-referenced (using flow cell 1 and a buffer blank) and fitted to a 1:1 Langmuir binding model with mass transport. Data from flow cells 2 and 3 were fitted globally.

The rate of complex formation ($K_a$) and dissociation ($K_D$) as well as overall dissociation constant ($K_D$) are provided in Table 2.

Example 4: Binding Affinity of Anti-TIM3 Antibodies to Human and Cyno TIM3 as Determined by Scatchard Analysis TIM3.18.IgG1.3 antibody was radioiodinated with $^{125}$I-Na (1 mCi; PerkinElmer Catalog NEZ033H001 MC) using IODO-GEN® solid phase iodination reagent (1,3,4,6-tetrachloro-3a-6a-diphenylglycouril; Pierce Catalog 28601). Excess iodide was removed using a desalting column (Pierce Catalog 43243). Fractions of labeled antibody were collected and analyzed for radioactivity on a Wizard 1470 gamma counter (PerkinElmer). The $^{125}$I-TIM3.18.IgG1.3 antibody concentration in each fraction was calculated with the Qubit fluorometer from Invitrogen. Radiopurity was established by thin layer chromatography of peak protein and radioactive fractions (Pinestar Technology Catalog 151-005).

Radio iodinated TIM3.18.IgG1.3 antibody binding to CHO cells expressing human or cyno TIM3 was demonstrated by incubating the CHO cells expressing human or cyno TIM3 with a titration of $^{125}$I-TIM3.18.IgG1.3 antibody. Nonspecific binding was determined by binding in the presence of a titration of a 100 fold molar excess of unlabeled antibody and was subtracted from total CPM to calculate specific binding. A linear standard curve of $^{125}$I-TIM3.18.IgG1.3 antibody concentration versus CPM was used to extrapolate specific activity, maximal nM bound $^{125}$I-TIM3.18.IgG1.3 antibody and thereby calculate receptor number per cell.

The results are shown in FIGS. 32A and 32B. The $^{125}$I-TIM3.18.IgG1.3 antibody standard curve (FIG. 32A) shows that 1 nM of $^{125}$I labeled antibody equals 81119.3 cpm. The number of receptors per cell was calculated by the following equation: (Bmax)×(Avogadro's number)×(Assay Volume)/# of cells per well. The results show that the TIM3.18.IgG1.3 antibody had an affinity of 0.26-0.48 nM for overexpressed human TIM3 on CHO cells (having 414,720 receptors per cell) and an affinity of 0.36-0.48 nM for overexpressed cyno TIM3 (having 235,944 receptors per cell).

A similar analysis conducted with $^{125}$I-TIM3.18.IgG1.3 antibody on activated human Th1 cells from 2 donors (50,000 cells/well) provided an affinity of 0.125-0.164 nM, despite an almost four fold difference in number of receptors per cell between donors (FIG. 33). Radio iodinated TIM3.18.IgG1.3 binding to human TIM3 was demonstrated by incubating activated primary human Th1 cells (prepared as described in other Examples herein) with a titration of $^{125}$I-TIM3.18.IgG1.3. Nonspecific binding was determined by binding in the presence of a titration of a 100 fold molar excess of unlabeled antibody and was subtracted from total

TABLE 2

Kinetics and affinity of binding of anti-TIM3 antibodies 13A3 and TIM3.18.IgG1.3 to human and cyno TIM3 proteins

| Ligand | Analytes | ka (1/Ms) | kd (1/s) | $K_D$ (nM) |
|---|---|---|---|---|
| Human TIM3 | hTIM3Fc/13A3 Fab | $3.2 \times 10^6$ | $6.9 \times 10^{-3}$ | 2.2 |
| Cyno TIM3 | cynoTIM3Fc/13A3 Fab | $2.4 \times 10^6$ | $5.3 \times 10^{-2}$ | 22 |
| Human TIM3 | hTIM3Fc/TIM3.18 Fab | $3.2 \times 10^6$ | $5 \times 10^{-3}$ | 1.6 |
| Cyno TIM3 | cynoTIM3Fc/TIM3.18 Fab | $3.4 \times 10^6$ | $5.9 \times 10^{-2}$ | 17 |

The experiments with 13A3 were not conducted on the same day as those with TIM3.18.

CPM to calculate specific binding. A linear standard curve of $^{125}$I-TIM3.18.IgG1.3 concentration versus CPM was used to extrapolate maximal nM bound $^{125}$I-TIM3.18.IgG1.3 and thereby calculate receptor numbers per cell.

Collectively, the above data confirms the results from the earlier Examples and shows that anti-TIM3 antibody 13A3, including its variant TIM3.18, can bind both human and cyno TIM3 with strong affinity.

Example 5: Lack of Cross-Reactivity of TIM3.18.IgG1.3 to Human TIM1, Human TIM4, and Mouse TIM3

Upon a blast search of the TIM3 IgV domain against the entire gene bank, the highest homologous molecules were TIM1 and TIM4 (45% identity). Selectivity profiling of TIM3.18.IgG1.3 using human TIM1 or TIM4-transfected cell lines by flow cytometry showed no cross-reactivity to TIM1 or TIM4. (Data not shown). It was also shown by flow cytometry on mouse TIM3 transfected cells, that TIM3.18.IgG1.3 is not cross-reactive with mouse TIM3 transfected cells. (Data not shown).

Example 6: IFN-γ Production by Tumor Infiltrating Lymphocytes (TILs) is Enhanced by Anti-TIM3 Antibodies To characterize the anti-TIM3 antibodies further and identify those that are more likely to have significant T cell stimulating activity in vivo, a specific T cell assay was developed. The assay measures the amount of IFN-γ secreted from tumor infiltrating lymphocytes (TILs), isolated from fresh tumor tissue, and incubated in the presence of irradiated CHO cells, expressing CD3 ("CHO-OKT3 cells"), in the presence or absence of a TIM3 antibody (or control). Without wanting to be limited by a specific mechanism of action, secretion of IFN-γ in the presence of a given anti-TIM3 antibody indicates that the antibody inhibits the negative signaling normally provided by TIM3 on the TILs, and stimulates activation (i.e., IFN-γ production) of the TILs.

Renal Cell Carcinoma

Fresh tumor tissue (including tumor infiltrating lymphocytes (TILs)) from a renal cell carcinoma patient was prepared into a single cell suspension by enzymatic digestion (Miltenyi, Catalog #130-095-929). The cell viability was more than 80%, as determined by FACS. Approximately 1.5×10s cells were co-cultured for 5 days with 2.5×10$^4$ irradiated (67,000 RAD for 1 hr 20 min; Rad Source Irradiator, RS-2000 Biological System) CHO-OKT3 cells in IL-2-containing medium (IL-2 (Peprotech, Catalog #200-02) at 20 IU/ml) in the presence of either an isotype control antibody or an anti-TIM3 antibody at different concentrations. At day 5 of the culture, the cell supernatant was collected and the IFN-γ level was assessed by ELISA (BD Opteia hIFNγ ELISA kit, BD, Catalog #555152). The results, which are shown in FIG. 21, indicate that the anti-TIM3 antibodies 13A3, 3G4, 17C3, 17C8, and 9F6 were able to stimulate IFN-γ production by the renal cell carcinoma TILs.

Lung Cancer

Fresh tumor tissue from a lung cancer patient was digested with a Miltenyi enzymatic digestion kit (Miltenyi, Catalog #130-095-929). The single cell suspension was co-cultured with irradiated (67,000 RAD for 1 hr 20 min; Rad Source Irradiator, RS-2000 Biological System) CHO-OKT3 cells in IL-2-containing medium (IL-2 (Peprotech, Catalog #200-02) at 20 IU/ml in the presence of an isotype control antibody or an anti-TIM3 antibody at different concentrations. At day 5 of the culture, the cell supernatant was collected for IFN-γ ELISA (BD Opteia hIFNγ ELISA kit, BD, Catalog #555152). As shown in FIG. 22A, the anti-TIM3 antibodies tested (i.e., 13A3 and 3G4) were able to stimulate IFN-γ production by lung cancer TILs.

In addition, at day 3.5 of a co-culture of the cell suspension from the lung cancer tumor tissue with irradiated (67,000 RAD for 1 hr 20 min; Rad Source Irradiator, RS-2000 Biological System) CHO-OKT3 cells treated with an isotype control antibody or anti-TIM3 antibody in the presence of IL-2, cells were incubated with BD GolgiStop overnight. Subsequently, the cells were first stained with cell surface markers, CD45, CD4, CD8, TIM3 and PD1, and then fixed and permeabilized with BD Cytofix/Cytoperm kit followed by intracellular IFN-γ staining. The results, which are shown in FIG. 17B, show that the percentage of intracellular IFN-γ expressing cells is increased in CD8$^+$ cells (lower panel) upon anti-TIM3 antibody treatment.

Additional Cancers

FIG. 23 shows the pooled data from multiple tumor TIL experiments (performed as described above in this Example) in response to anti-TIM3 antibodies 13A3 or 3G4 (i.e., every dot on the figure represents TILs from one patient tumor sample treated with either 13A3 or 3G4). In agreement with the data provided above, the anti-TIM3 antibodies induced the production of IFN-γ in TILs isolated from all the renal cell carcinoma (RCC) and lung cancer patients. Similarly, the TILs from the two pancreatic cancer patients also produced IFN-γ in response to the anti-TIM3 antibodies. In contrast, the TILs from the single thyroid tumor patient did not appear to produce IFN-γ in response to the anti-TIM3 antibody treatment.

Collectively, the above data demonstrate that the anti-TIM3 antibodies disclosed herein can effectively bind to TIM3 and induce TILs (primarily CD8$^+$ T cells) from different cancers to produce IFN-γ.

Example 7: FACS Based Cross-Blocking of Anti-TIM3 Antibodies

Total human T cells were isolated from PBMC using a Miltenyi T cell purification kit and activated with plate-bound anti-CD3 (1 sg/ml; Anti-CD3 clone OKT3, eBioscience, Catalog #16-0037-85) and soluble anti-CD28 (1 μg/ml; Anti-CD28 clone CD28.2, BD Biosciences, Catalog #555725) for 4 days. TIM3 was expressed in >80% of T cells, as determined by FACS. The T cells were incubated with various anti-TIM3 antibodies for 30 minutes, followed by incubation with selected biotin-labeled anti-TIM3 antibodies for 30 minutes and detected by PE-conjugated streptavidin. The results, which are shown in FIGS. 24A and 24B, indicate that antibodies 13A3, 3G4, 17C3, 17C8, 9F6, 14H7, and 23B3 are in the same binning group (Group I), i.e., cross-compete each other, while antibodies 8B9 and 8C4 are in a separate binning group (Group II), i.e., do not cross-compete with the antibodies in Group I, but cross-compete with each other. The antibodies in binning group I were shown to have biological activity (see Examples), while those in binning group II had weaker activity. Two anti-TIM3 antibodies which did not cross-compete with either Group I or Group II, did not appear to have any biological activity. The antibodies of binning group I were also those that interfered with TIM3 binding to PS (as further described herein).

Example 8: Epitope Mapping by Yeast Surface Display Method

The nucleotide sequence encoding the extracellular domain of human TIM3 (NM_032782), i.e., SEVEY- RAEVGQNAYLPCFYTPAAPGNLVPVCWGK-
GACPVFECGNVVLRTDERDVNYWTSRYWLNGD
FRKGDVSLTIENVTLADSGIYC-
CRIQIPGIMNDEKFNLKLVIKPAKVTPAP-
TRQRDFTAAFPRMLTTRGH
GPAETQTLGSLPDINLTQISTLANELRDSRLAND-
LRDSGATIRIG, (SEQ ID NO: 290) was cloned into the yeast display plasmid PDV0023 by ligation into the XhoI and NotI restriction enzyme sites. Low rate random mutagenesis was performed on the sequence to generate single point mutations across the TIM3 coding region using the GeneMorph II Random Mutagenesis kit from Agilent Technologies. A library of $9.8 \times 10^6$ clones was generated in VWK18 gal *S. cerevisiae* cells. $2 \times 10^8$ library cells were passaged and induced for antibody labeling and cell sorting. About $2 \times 10^7$ induced cells were incubated with 100 nM a primary target anti-human TIM3 antibody and 100 nM anti cMyc (9E10) antibody for 1 hr at 25° C. Cells were washed then detected with fluorescently labeled goat anti human IgG-PE and goat anti-mouse IgG-A633 secondary antibodies for 45 min at 4C to detect the bound primary antibodies on the cell surface. Labeled cells were sorted on a BD FACSARIA II instrument into yeast culture media. Cells that were positively labeled with anti-Myc antibody and negatively labeled with anti-human TIM3 were collected. The APC$^+$/PE$^-$ population of cells were expanded, passaged, and induced for a second round of identical labeling and sorting to enrich the desired populations. Yeast plasmid DNA was purified out of about $2 \times 10^7$ cells from the unselected library and both rounds of selected, sorted cells. For each cell population, the TIM3 target sequence was rescued and purified out of the yeast plasmid DNA by PCR using vector specific primers that flank the human TIM3 sequence. The target sequence PCR products were subjected to NGS library preparation using the Nextera XT DNA Library kit for Illumina Sequencing from Illumina. The prepared libraries were sent to EA/Q2 Solutions for high throughput sequencing on the MiSeq platform from Illumina with 300 cycles/flow cell. Between 0.5 and 1.0 million sequence reads for each library were compared to the wild type TIM3 sequence, and mutations at each position along the sequence were tabulated. The difference in mutational frequency at each residue position between the selected rounds and the unselected library were calculated and used to determine critical residues for antibody binding. Positions with high mutation frequency were examined for surface exposure using a human TIM3 structural model based on known crystal structures of mouse TIM3 (PDB: 2OYP, and PDB: 3BIB). High mutation frequency, surface exposed residues are considered part of epitopes, while high mutation frequency, buried residues are considered as false positives. False positive residues are usually those that disrupt either local or core folding of the protein, and indirectly alter binding of the Ab to its surface epitope.

FIG. 25 shows the residues that were determined to be part of the epitope on human TIM3 for each of the anti-TIM3 antibodies used (i.e., 13A3, 3G4, 17C3, and 8B9). In addition, D104 showed positive mutational score, in all mappings, and can be a structural salt bridge to R81. For the 8B9 epitope, L84 showed high mutation frequency, though it appeared buried in the structure supporting the epitope residues. Q113 showed a low, but positive score for the 13A3 antibody. This residue likely plays an epitope region structural supporting role, but appeared to have some surface exposure.

Example 9: Blocking of TIM3-PtdSer Interaction by TIM3 Antibodies

The "tandem blocking assay" shown in FIG. 26A was used to determine whether the anti-TIM3 antibodies disclosed herein can inhibit the interaction between human TIM3 and phosphatidylserine ("PtSer" or "PS"). Since PS is not water soluble, PS-liposome was made for the assay. Briefly, lipids were mixed with methanol/chloroform and then chloroform was evaporated under nitrogen stream and vacuum overnight. Subsequently, the lipids were sonicated with micro tip to fully disperse lipid to create liposome. They were further passed through an extruder >10 times to ensure homogenous size.

PS liposome were generated with PS (L-α-phosphatidylserine (Brain, Porcine) Avanti Polar Lipids Cat #840032C) suspended in chloroform. The PS stock was first diluted in chloroform to the necessary amount, and then, the chloroform was evaporated under a nitrogen stream until no liquid was visible. To remove trace amounts of the chloroform, dried PS was placed under vacuum overnight. Dried PS was then suspended in PBS via vortex and briefly sonicated until the solution turned cloudy. To create size defined PS liposomes, an extruder with a 100 nm filter was used. Suspended PS was loaded into the extruder and passed through the filter at least 10 times. At this point, the PS liposome was diluted in PBS to the needed concentration.

In the "tandem blocking assay", TIM3 (ECD)-Fc was captured on Octet biosensor, and anti-TIM3 antibody and PS-liposomes were allowed to bind to the TIM3 protein. When an anti-TIM3 antibody binds to a region that blocks PS binding, PS-liposome would show no binding.

The results, which are shown in FIG. 26B, indicate that antibodies 3G4, 13A3, 17C3, and 17C8 were able to inhibit the binding of PtSer to human TIM3. In contrast, two other anti-TIM3 antibodies, which bind to TIM3 at a different region (i.e., AbA and AbB), did not inhibit binding. As further described in the Examples (see, e.g., Examples 6 and 13), the antibodies that inhibited PtSer binding to TIM3 were also those with the strongest functional activity (as determined in the Th1 and TIL assays).

Example 10: HDX-MS Epitope Mapping of TIM3 Antibodies

Hydrogen/deuterium exchange mass spectrometry (HDX-MS) was utilized to probe binding epitopes of hTIM3 with antibodies 13A3 and 3G4.

HDX-MS probes protein conformation and conformational dynamics in solution by monitoring the rate and extent of deuterium exchange of backbone amide hydrogen atoms. The level of HDX depends on the solvent accessibility of backbone amide hydrogen atoms and the protein hydrogen bonds. The mass increase of the protein upon HDX can be precisely measured by MS. When this technique is paired with enzymatic digestion, structure features at the peptide level can be resolved, enabling differentiation of surface exposed peptides from those folded inside, or from those sequestered at the interface of a protein-protein complex. Typically, the deuterium labeling and subsequent quenching experiments are performed, followed by enzymatic digestion, peptide separation, and MS analysis.

Prior to the epitope mapping experiments, non-deuterated experiments were carried out to generate a list of common peptides for recombinant human TIM3 ((hTIM3-ECD (22-200) His-tagged (see FIG. 30); 10 μM, Sino Biological Inc.) and protein complexes of hTIM3 with Fab of antibodies 13A3 and 3G4 (1:1 molar ratio). The samples were injected into Waters Enzymate BEH pepsin enzyme column (2.1×30 mm), and digested for 3 min at 200° C. The cooling chamber of the UPLC system, which housed all the chromatographic elements, was held at 0.0±0.1° C. for the entire duration of the measurements. The injected peptides were trapped and desalted for 3 min at 100 µL/min and then separated in 6 min by a 5-40% acetonitrile-water gradient at 65 µL/min. The separation column was a 1.0 mm×50.0 mm ACQUITY UPLC BEH C18 column (Waters). Identification of the peptic peptides was accomplished through a combination of exact mass analysis and MSE using ProteinLynx Global SERVER 2.5 (Waters) on Waters HDX-MS system.

In the HDX-MS experiment, 5 µL of each sample (hTIM3 or hTIM3 with Fab of antibody 13A3 or 3G4) was diluted into 55 µL of $D_2O$ buffer (10 mM phosphate buffer, $D_2O$, pH7.0) to start the labeling reactions. The reactions were carried out for different periods of time: 1 min, 10 min, and 240 min. By the end of each labeling reaction period, the reaction was quenched by adding quenching buffer (100 mM phosphate buffer with 4M GdnCl and 0.4M TCEP, pH 2.5, 1:1, v/v). 50 µL of quenched sample was digested online using the same conditions as in non-deuterated experiments. All comparison experiments were performed under identical experimental conditions. All experiments were performed in duplicate. The resulting relative deuterium levels were plotted versus the exchange time with use of the software program DynamX 3.0™ (Waters).

As shown in FIG. 30, sequence coverage of 97.3% of hTIM3 was obtained in the HDX-MS experiments. As shown in FIG. 31, HDX-MS data analysis of hTIM3 upon binding with Fab of antibodies 13A3 and 3G4 identified the following discontinuous epitopes:

```
mAb 13A3:
                                         (SEQ ID NO: 367)
49VPVCWGKGACPVFE62, (SEQ ID NO: 368)
111RIQIPGIMNDEKFNLKL127,
and fragment
119NDEKFNLKL127 thereof;
and mAb 3G4:
                                         (SEQ ID NO: 369)
40YTPAAPGNLVPVCWGKGACPVFE62, (SEQ ID NO: 370)
66VVLRTDERDVNY77, (SEQ ID NO: 371)
78WTSRYWLNGDFRKGDVSL95,
and (SEQ ID NO: 372)
110CRIQIPGIMNDEKFNLKL127.
```

FIG. 31 shows the HDX-MS peptides to which antibodies 13A3 and 3G4 bind, as determined using the HDX-MS protocol described in this Example Thus, the above data demonstrate that antibody 13A3 interacts with amino acid residues 49-62 and 111-127 of hTIM3, but does not significantly interact with other regions, such as the region that is N-terminal to amino acid residue Y40 or V49, the region that is located between amino acid residues E62 and R111, and the region that is C-terminal to amino acid residue L 127. The data also shows that 13A3 antibody binds to the phosphatidylserine binding loop of the TIM3 IgV domain.

Example 11: On-Target IHC Staining by TIM3.18 in Human Tissue Cross-Reactivity Immunohistochemistry (IHC) was performed with anti-TIM3 antibody 13A3 on frozen sections of human and cynomolgus monkey spleen. In both species, the 13A3 antibody (0.5 µg/mL) stained the endothelium of venous sinusoids. (Data not shown). As expected, antibody 3G4, which does not cross-react with cynomolgus TIM3, stained the human spleen but not the cynomolgus spleen. (Data not shown).

In preliminary tissue cross-reactivity analysis, FITC-conjugated TIM3.18.IgG1.3 antibody was applied to frozen sections or smears from 20 different types of normal human tissues, which included cerebrum, cerebellum, heart, liver, lung, kidney, PBMC smears, spleen, tonsil, thymus, skin, colon, small intestine, stomach, pancreas, peripheral nerve, pituitary, thyroid, prostate, and placenta (one donor each). Specific staining was observed in a subset of mononuclear cells (MNC) in PBMC, spleen, and tonsil, as well as in epithelial reticular cells or macrophages in the thymus. (Data not shown). The most profound staining was noticed in the macrophage/DC-like cells, which were observed in every tissue examined, including tissue-specific macrophages (e.g., Kupffer cells in the liver, dermal macrophages/DC in the skin, and Hofbauer cells in the placenta). At the organ level, the strongest staining was found in the spleen. Besides small subsets of MNC, strong staining was very frequently seen in splenic endothelial cells in the red pulp. In addition, positive staining was observed in a small subset of cortical tubular epithelial cells in the kidney cortex. (Data not shown).

Example 12: Anti-Tumor Activity of Combined Anti-TIM3 and PD-1 Antibodies in Mice Rat anti-mouse TIM3 (RMT3 23) and PD-1 (RMP1-14) commercial antibodies (Bio-X-Cell) were evaluated in a CT26 colorectal tumor model. The experimental design was similar to a previously described in vivo study Ngiow et al. (2011) Cancer Res. 71:3540. Since TIM3 is expressed relatively late in this tumor model, a small volume of tumor cells ($2×10^5$) was implanted in the flank of each mouse so that tumor growth would be minimal, allowing time for TIM3 expression. When tumors became palpable at Day 8, mice were randomized into 4 treatment groups of 10 mice each, with a mean tumor volume of 40 $mm^3$. RMT3-23 (anti-TIM3 antibody) and RMP1-14 (anti-PD-1 antibody) were administered by intraperitoneal injection, either as single or combined agents (250 sg/per injection of each antibody); the isotype control was administered at 500 sg/per injection. Each study animal received 250 sg of one antibody or 500 sg of 2 combined antibodies for each injection and for a total of 3 doses. Tumor size was assessed biweekly.

As shown in FIG. 29A, mice in each group receiving single or combined test antibodies exhibited some antitumor activity, but the greatest activity was observed in animals that received the combination of anti-TIM3 antibody and anti-PD-1 antibody. For example, at the termination of the study, 2/10 mice in the anti-PD-1 monotherapy group were tumor-free, whereas in the combined anti-PD-1 and anti-TIM3 group, 6/10 of the mice were tumor-free (FIG. 29A). A previous CT26 study of the same design produced similar results, with 3/10 mice in the anti-PD-1 monotherapy group and 7/10 mice in the combined anti-PD-1 and anti-TIM3 group tumor-free. There was little or no antitumor activity with anti-TIM3 administered as a single agent (FIG. 29A, upper right panel).

Of note, the $EC_{50}$ value of RMT3-23 binding to activated mouse T cells is 1.7 nM, which is 17-fold weaker than the $EC_{50}$ of TIM3.18 for binding to human TIM3 (see, e.g., Example 2 and FIGS. 17A and 17B). Another rat anti-mouse TIM3 antibody, (Ab M), which cross-blocks RMT3-23, has an $EC_{50}$ of 0.1 nM in binding to activated mouse T cells, which is equivalent to the $EC_{50}$ of TIM3.18. Like RMT3-23, Ab M maps to the PS-binding loops of mouse TIM3. Use of this antibody with a mIgG1-D265A (Fc-inert isotype) heavy chain constant region in the CT26 tumor model demonstrated that it enhanced the antitumor response to anti-PD-1 (FIG. 29B).

Example 13: Th1 Cell Proliferation Assay with TIM3 Antibody (Full Length or Fab) Blockade To further characterize the anti-TIM3 antibodies, a specific T cell proliferation assay using in vitro polarized Th1 cells was developed. Polarized Th1 cells were obtained by repeatedly restimulating naïve CD4$^+$ T cells. These cells were then incubated with irradiated (growth arrested) CHO-OKT3 cells in the presence of anti-TIM3 antibodies (or control) and Th1 cell proliferation was measured.

Naïve CD4 T cells were polarized to Th1 memory-like T cells as follows. Naïve CD4 T cells were purified from PBMCs using a naïve CD4 T cell isolation kit from Miltenyi. The cells were cultured for 3-4 days in IMDM/10% FBS at $3.6\times10^5$ cells/ml in the presence of: CD3/CD28 coated (80%/20% respectively) beads at 1 bead to 1 cell ratio; 10 ng/ml human IL-2; 1 ng/ml human IL-12 and 10000 ng/ml anti-human IL-4 antibody. After the incubation, the cells were collected in a tube, the beads were removed with a magnet and the cells were returned to culture in a new flask. Recombinant human IL-2 was added to a final concentration of 4 ng/ml, and the cells were incubated for an additional 3 days. The cells were then collected and washed with 1× IMDM/10% FBS. The cells were counted, resuspended in IMDM/10% FBS at $4.1\times10^5$ cells/ml, and cultured for 3-4 days in the presence of: CD3/CD28 coated (80%/20% respectively) beads at 1 bead to 1 cell ratio; 10 ng/ml human IL-2; 1 ng/ml human IL-12 and 10000 ng/ml anti-human IL-4 antibody. After the incubation, the cells were collected in a tube, the beads were removed with a magnet and the cells were returned to culture in a new flask. Recombinant human IL-2 was added to a final concentration of 4 ng/ml, and the cells were incubated for an additional 2-3 days. The polarized Th1 cells were then harvested and washed 3 times. On the day of assay set-up, the polarized Th1 cells were re-suspended in complete medium.

The following reagents were used:

| | | |
|---|---|---|
| Dynabeads M-450 Epoxy | Dynal Biotech ASA | 140.11 |
| 100 mM Sodium Phosphate Buffer, pH 8.5 | Teknova | 0214-250 |
| Functional Grade anti-hCD3 Clone UCHT-1 | eBioscience | 16-0038-85 |
| Functional Grade anti-hCD28 Clone CD28.2 | eBioscience | 16-0289-85 |
| Recombinant Human IL-2 | PeproTech, Inc. | 200-02 |
| Recombinant Human IL-12 | PeproTech, Inc. | 200-12 |
| anti-human IL-4 | eBioscience | 16-7048-85 |
| Iscove's DMEM | Mediatech, Inc. | 10-016-CM |
| Fetal Bovine Serum (heat-inactivated) | Hyclone | SH30071.03 |

The CHO-OKT3 cell line was grown in shaker flasks and irradiated (67,000 RAD for 1 hr 20 min; Rad Source Irradiator, RS-2000 Biological System) on the day of assay set-up. The irradiated CHO-OKT3 cells provided T cell stimulation and exposed phophatidylserine (PS) as confirmed by Annexin V staining.

TIM3.18.IgG1.3 or isotype control was titrated from 20 µg/mL by 4-fold serial dilutions, with each condition set up in triplicate. TIM3.18.IgG1.3 Fab was titrated from 53 µg/mL also by 4-fold serial dilution. The TIM3.18.IgG1.3 Fab fragment was the same as that used in the crystallography experiment (see Examples).

The cultures were set up in flat-bottom TC-treated 96-well plates (Costar) with $1\times10^5$ polarized Th1 cells and $2.5\times10^4$ irradiated CHO-OKT3 cells (CHO:T cell ratio of 1:4) in 200 µL complete medium per well in the presence of 0.1 µg/ml anti-CD28 (clone CD28.2, BD Biosciences, Catalog #555725), and incubated for 3 days at 37° C. and 5% $CO_2$. The plates were then pulsed with 1 µCi tritiated thymidine (Perkin Elmer, Catalog #NET027001MC) per well for 16 hours and then the cells were harvested onto filter plates (Perkin Elmer) for analysis of tritiated thymidine incorporation in order to assess proliferation.

The results, which are shown in FIGS. 34A and 34B, indicate that the anti-TIM3 antibody TIM3.18.IgG1.3 increased Th1 cell proliferation in a dose-dependent manner in the CHO-OKT3/Th1 co-culture cell assay. The overall activity of TIM3.18.IgG1.3 was equivalent to that of its parental antibody, 13A3 (IgG4 isotype) (FIG. 34A). TIM3.18.IgG1.3 Fab fragment also exhibited a dose-dependent induction of proliferation (FIG. 34B) in the CHO-OKT3/Th1 cell assay. Similar results were observed with the TIM3.24 and TIM3.25 antibodies (FIG. 35).

Thus, TIM3.18.IgG1.3 (both full length and Fab) potentiated Th1 cell activity in a dose-dependent manner in co-culture with irradiated CHO-OKT3 cells. The presence of activity with the Fab fragment indicated that TIM3.18.IgG1.3 works as an antagonistic antibody and confirms TIM3 as an inhibitory receptor for T cell function. No Fc cross-linking was required for TIM3.18.IgG1.3 biological activity.

Example 14: Th1 Cell Proliferation Assay with TIM3 and PD 1 Co-Blockade

This assay was a co-culture between irradiated (growth arrested; 67,000 RAD for 1 hr 20 min; Rad Source Irradiator, RS-2000 Biological System) CHO-OKT3 cells transfected with human PD-L1 (CHO-OKT3-PD-L1), and Th1 cells at a CHO:T cell ratio of 1:4 in the presence of anti-CD28. The CHO-OKT3-PD-L1 cell line was grown in shaker flasks and irradiated on the day of assay set-up. The polarized Th1 cells were prepared as described in the other Examples described herein. On the day of assay set-up, the polarized Th1 cells were re-suspended in complete medium.

Anti-PD-1 antibody nivolumab was titrated from 10 µg/mL by 10-fold serial dilutions, with each condition set up in triplicate. Anti-TIM3 antibody TIM3.18.IgG1.3 or isotype control was spiked in at 20 µg/mL.

The cultures were set up in flat-bottom TC-treated 96-well plates (Costar) with $1\times10^5$ Th1 cells and $2.5\times10^4$ CHO- OKT3-PD-L1 cells in 200 μL complete medium per well in the presence of 0.1 μg/ml anti-CD28 (clone CD28.2, BD Biosciences, Catalog #555725), and incubated for 3 days at 37° C. and 5% $CO_2$. The plates were then pulsed with 1 μCi tritiated thymidine (Perkin Elmer, Catalog #NET27001MC) per well for 16 hours and then the cells were harvested onto filter plates (Perkin Elmer) for analysis of tritiated thymidine incorporation in order to assess proliferation.

The results, which are shown in FIG. 36, indicate that anti-PD-1 antibody nivolumab increased proliferation of Th1 T cells stimulated with CHO-OKT3-PD-L1 cells in a dose-dependent manner, and that the proliferation was greatly enhanced in combination with TIM3.18.IgG1.3. Co-blockade of TIM3 and PD-1 pathways showed additive effect in this assay and in agreement with the anti-tumor activity data described earlier in Example 12.

Example 15: Tumor-Infiltrating Lymphocyte IFN-γ Release Assay with TIM3.18.IgG1.3 Blockade For this assay, fresh tumor tissues were obtained from a surgically removed human renal cell carcinoma sample or breast cancer sample. The tumor-infiltrating lymphocytes (TIL) were isolated using an enzymatic dissociation kit (Miltenyi, Catalog 130-095-929). TILs were supplemented with 20 IU/mL IL-2 (Recombinant human IL-2, Peprotech, Catalog 200-02) and co-cultured with irradiated (growth arrested; 67,000 RAD for 1 hr 20 min; Rad Source Irradiator, RS-2000 Biological System) CHO-OKT3 cells at a CHO:T ratio of 1:6. The CHO-OKT3 cell line was grown in shaker flasks and irradiated on the day of assay set-up.

TIM3 antibody TIM3.18.IgG1.3 or isotype control was titrated from 20 μg/mL by 4-fold serial dilutions, with each condition set up in triplicate. The cultures were set up in flat-bottom TC-treated 96-well plates (Costar) with $1.5\times10^5$ T cells and $2.5\times10^4$ irradiated CHO-OKT3 cells in 200 μL per well in IMDM+5% FBS and 5% human AB serum (Gemini, Catalog #100-512), and incubated for 5 days at 37° C. and 5% $CO_2$. The supernatant was harvested from each sample for IFN-γ measurement by ELISA (BD Opteia hIFN-γ ELISA kit, BD, Catalog 555152).

The results, which are shown in FIG. 37, for the renal cell carcinoma TILs, and in FIG. 38, for the breast cancer TILs indicate that TIM3.18.IgG1.3 increased IFN-γ production in a dose-dependent manner in the CHO-OKT3TIL co-culture assay, with up to 4-fold increase over negative controls at higher concentrations of TIM3.18.IgG1.3 in the renal cell carcinoma TIL assay.

Example 16: TIM3.18.IgG1.3 Promotes IFN-γ Secretion in M0:T Allogeneic MLR Assay Isolated CD14+ monocytes from healthy donors were differentiated to the M0 stage in culture medium containing M-CSF. After Day 6 in culture, a significant population of macrophages were expressing CD163+ and CD206+ on the cell surface by FACS staining, consistent with the signature of suppressive macrophages. By flow cytometry with an anti-TIM3 antibody, TIM3 was shown to be expressed in the M0 macrophages (FIG. 39). These M0 macrophages were then irradiated (5,000 RAD for 7 min; Rad Source Irradiator, RS-2000 Biological System) and co-cultured with an allogenic donor's total T cells, and at Day 6 post-co-culturing, the mixed cells were pulsed with ³H-thymidine overnight for assessing T cell proliferation.

The results, which are shown in FIG. 40, indicate that TIM3.18.IgG1.3 antibody increased T cell proliferation as compared to isotype control.

Example 17: Crystal Structure of TIM3.18.IgG1.3 Fab Interacting with hTIM3 hTIM3 IgV region was co-crystallized with a Fab fragment of TIM3.18 as follows. The sequences used were the following:

```
hTim3_IgV:
HHHHHHSAALEVLFQGPGSEVEYRAEVGQNAYLPCFYTPAAPGNLVPVC

WGKGACPVFECGNVVLRTDERDVNYWTSRYWLNGDFRKGDVSLTIENVT

LADSGIYCCRIQIPGIMNDEKFNLKLVIKPA (SEQ ID NO: 377;

TIM 3 sequence is underlined)

Tim3.18_Fab:
                                     (SEQ ID NO: 366)
QLQLQESGPGLVKPSETLSLTCTVSGGSISSRSYYWGWIRQPPGKGLEW

IGSIYYSGFTYYQPSLKSRVTISVDTSKNQFSLKLSSVTAADTAVYYCA

TGGPYGDYAHWFEPWGQGTLVTVSSASTKGPSVFPLAPSSKSTSGGTAA

LGCLVKDYFPEPVTVSWNSGALTSGVHTFPAVLQSSGLYSLSSVVTVPS

SSLGTQTYICNVNHKPSNTKVDKRVEPKSCGGHHHHHH

Tim3.18_kappa:
                                      (SEQ ID NO: 29)
EIVLTQSPGTLSLSPGERATLSCRASQSVSSSYLAWYQQKPGQAPRLLI

YGASSRATGIPDRFSGSGSGTDFTLTISRLEPEDFAVYYCQQYGSSPIT

FGQGTRLEIKRTVAAPSVFIFPPSDEQLKSGTASVVCLLNNFYPREAKV

QWKVDNALQSGNSQESVTEQDSKDSTYSLSSTLTLSKADYEKHKVYACE

VTHQGLSSPVTKSFNRGEC
```

Expression and purification. A histidine tagged hTim3 IgV domain was expressed in *E. Coli* (BL21 DE3) with a pET47b vector. Purification and refolding was done following published protocol for mTim3 (DeKruyff et al. J. Immunology 2010). Tim3.18 Fab was transiently expressed in HEK293 cells, and purified via the C-terminal His Tag on the heavy chain.

Crystallization of complex and structure determination. The crystal structure of hTim3 IgV domain with Tim3.18 Fab was resolved to 1.5Å. The Fab:antigen complex was first screened for cyrstallization conditions with various screens from Hampton Research, and crystals clusters were observed in conditions with PEG 3350 with pH ranging from 6.5 to 5.5. The crystal growth condition was further optimized to allow the growth of single crystals. Single crystals were harvested with glycerol as the cryoprotectent, and flash frozen in liquid nitrogen. Data collection was conducted at IMCA-CAT at APS using Pilatus-6M detector. Diffraction images were processed with Global Phasing software, and phased using a Fab model of Tim3.18. Multiple rounds of refinement were done using CCP4 suite, Coot, Phenix, and Global Phasing suite of software.

The resolved hTim3 IgV domain matches well to that of the published hTim3 structure (PDB: 5F71; worldwideweb.rcsb.org/pdb/explore/explore.do?pdbId=5F71), as well as to mTim3 structure (PDB: 3KAA; worldwideweb.rcsb.org/pdb/explore/explore.do?structureId=3kaa; Rosemarie et al. (2010) *J Immunol* 184:1918) that was resolved in complex with PS. The PS binding pocket in hTim3 was inferred from these structural alignments. Additionally, the location of the PS binding pocket is conserved among the TIM members in human and mouse (Freemen et al. (2010) *Immunol Rev.* 235: 172).

The contact residues for TIM3.18 on the hTim3 protein were identified by calculating the difference in accessible surface area between the hTIM3:TIM3.18 Fab crystal structure and hTIM3 structure alone ("surface burial method"). hTIM3 residues that show buried surface area upon complex formation with TIM3.18 Fab were defined as being part of the contact residues. The solvent-accessible surface of a protein was defined as the locus of the center of a probe sphere (representing a solvent molecule of 1.4-A radius) as it rolls over the Van der Waals surface of the protein. The solvent-accessible surface area was calculated by generating surface points on an extended sphere about each atom (at a distance from the atom center equal to the sum of the atom and probe radii), and eliminating those that lied within equivalent spheres associated with neighboring atoms as implemented in the program AREAIMOL (worldwideweb.ccp4.ac.uk/newsletters/newsletter38/03_surfarea.html).

The results, which are shown in FIGS. 41 and 42, provide that the following amino acids are contact residues, as identified by the above described surface burial method: P29, V30, C31, P38, V39, F40, E41, C42, G43, N44, V45, V46, L47, R48, T49, D50, E51, D53, R90, Q92, G95, I96, M97, D99 (numbering according to SEQ ID NO: 290, which is the mature hTIM3 extracellular domain) or P50, V51, C52, P59, V60, F61, E62, C63, G64, N65, V66, V67, L68, R69, T70, D71, E72, D74, R111, Q113, G116, I117, M118, D120 (numbering per SEQ ID NO: 286 (FIG. 25), which is hTIM3 with a signal peptide). These results indicate that the contact residues of TIM3.18.IgG1.3 on human TIM3 overlap with the PS binding pocket on human TIM3. Specifically, the heavy chain CDR2 of TIM3.18 occupies the PS binding pocket. Additional contacts with the PS binding loops are made by heavy chain CDR1 and CDR3. The structural data generated here confirms the results obtained in the PS blocking assay described earlier in Example 9.

The crystallography results also show that the following amino acid residues of hTIM3 have an atom that is located within 5 A of an atom of an amino acid residue (the "5 A distance method") of the TIM3.18 Fab: P29, V30, C31, P38, V39, F40, E41, C42, G43, N44, V45, V46, L47, R48, D50, E51, D53, R90, I91, Q92, G95, I96, M97, D99 (numbering according to SEQ ID NO: 290, which is the mature hTIM3 extracellular domain) or P50, V51, C52, P59, V60, F61, E62, C63, G64, N65, V66, V67, L68, R69, D71, E72, D74, R111, I112, Q113, G116, I117, M118, D120 (numbering per SEQ ID NO: 286 (FIG. 25), which is hTIM3 with a signal peptide). The specific interacting residues of the Fab and hTIM3 protein are set forth in Table 3.

Table 3. Listing of Human TIM3 Residues Interacting with Fab Residues

TABLE 3

Listing of human TIM3 residues interacting with Fab residues

| Tim3 residue | Tim3.18 Antibody | | |
|---|---|---|---|
| | heavy/light chain | residue # | residue type |
| 29(PRO) | H/ | 56 | (SER) |
| | H/ | 57 | (GLY) |
| | H/ | 58 | (PHE) |

TABLE 3-continued

Listing of human TIM3 residues interacting with Fab residues

| Tim3 residue | Tim3.18 Antibody | | |
|---|---|---|---|
| | heavy/light chain | residue # | residue type |
| 30(VAL) | H/ | 56 | (SER) |
| | H/ | 58 | (PHE) |
| 31(CYS) | H/ | 58 | (PHE) |
| | H/ | 55 | (TYR) |
| 38(PRO) | H/ | 106 | (TYR) |
| 39(VAL) | H/ | 60 | (TYR) |
| | H/ | 106 | (TYR) |
| | L/ | 92 | (TYR) |
| | L/ | 93 | (GLY) |
| | L/ | 94 | (SER) |
| | L/ | 95 | (SER) |
| 40(PHE) | H/ | 49 | (TRP) |
| | H/ | 54 | (TYR) |
| | H/ | 60 | (TYR) |
| | H/ | 106 | (TYR) |
| | H/ | 108 | (HIS) |
| | L/ | 95 | (SER) |
| | L/ | 97 | (ILE) |
| 41(GLU) | H/ | 54 | (TYR) |
| | H/ | 55 | (TYR) |
| | H/ | 55 | (SER) |
| | H/ | 58 | (PHE) |
| | H/ | 60 | (TYR) |
| | H/ | 103 | (TYR) |
| 42(CYS) | H/ | 103 | (TYR) |
| | H/ | 104 | (GLY) |
| 43(GLY) | H/ | 103 | (TYR) |
| | H/ | 104 | (GLY) |
| | H/ | 105 | (ASP) |
| | H/ | 106 | (TYR) |
| 44(ASN) | H/ | 103 | (TYR) |
| | H/ | 104 | (GLY) |
| | H/ | 105 | (ASP) |
| 45(VAL) | H/ | 32 | (ARG) |
| | H/ | 33 | (SER) |
| | H/ | 55 | (TYR) |
| | H/ | 103 | (TYR) |
| | H/ | 104 | (GLY) |
| 46(VAL) | H/ | 32 | (ARG) |
| 47(LEU) | H/ | 32 | (ARG) |
| | H/ | 55 | (TYR) |
| 48(ARG) | H/ | 30 | (SER) |
| | H/ | 31 | (SER) |
| | H/ | 32 | (ARG) |
| | H/ | 55 | (TYR) |
| 50(ASP) | H/ | 55 | (TYR) |
| | H/ | 56 | (SER) |
| 51(GLU) | H/ | 30 | (SER) |
| 53(ASP) | H/ | 32 | (ARG) |
| 90(ARG) | H/ | 58 | (PHE) |
| | H/ | 60 | (TYR) |
| 91(ILE) | H/ | 58 | (PHE) |
| 92(GLN) | H/ | 57 | (GLY) |
| | H/ | 58 | (PHE) |
| | H/ | 59 | (THR) |
| | H/ | 60 | (TYR) |
| 95(GLY) | H/ | 66 | (LYS) |
| 96(ILE) | H/ | 66 | (LYS) |
| 97(MET) | H/ | 66 | (LYS) |
| 99(ASP) | H/ | 58 | (PHE) |
| | H/ | 60 | (TYR) |

A comparison of the amino acid residues identified by both methods shows that the residues are essentially the same, except for residue T49 that is identified only by the surface burial method, and residue I91 that is identified only by the "5 A distance method."

Example 18: Additional Characteristics of TEM3.18.IgG1.3

Biophysical characteristics of TIM3.18.IgG1.3 expressed in CHO cells are provided in Table 4.

TABLE 4

Biophysical Characteristics of TIM3.18.IgG1.3

| Property | Method | Results |
|---|---|---|
| Identity | LC-MS/MS peptide map | Deglycosylated MW = 145,619 Da (as predicted) |
| | | Deglycosylated, reduced and alkylated HC = 50,068 Da |
| | | Aglycosylated, reduced and alkylated LC = 23,683 Da |
| | | >99% sequence and disulfide structure confirmed by Peptide mapping and mass spec |
| Purity/Homogeneity | CE-SDS | 95.1% monomer, impurities include 2.9% HHL, 0.9% HL, 0.5% HH, 0.6% LC; Non-glycosylated heavy chain 2.1% |
| | SEC | 98.5% monomer |
| | SE-MALS | 99.94% (150 kDa), 0.06% (322 kDa) |
| | HIC-HPLC | 92% main peak, 1% pre-main peak, 7% post main peak |
| | CE (Glycans) | G0F (79.3%), G1F (12.2%), G2F (0.7%), Man5 (6.8%), G0 (0.9%). |
| | cIEF | Main peak pI = 8.6, pI range 8.17-8.66 |
| Chemical Modifications | LC-MS/MS peptide map | Very low |
| Thermal Stability and Reversibility | DSC (diluted into storage buffer) | Tm1 = 68.1° C., Tm2 = 80.3° C., Tm3 = 82.6° C. Reversibility at 74° C. = 96%, at 80° C. = 26% |

A single N glycosylation site was confirmed at N297 on the heavy chain, with a glycan profile that is consistent with the glycan profile of CHO-expressed IgG1 monoclonal antibodies. TIM3.18.IgG1.3 does not bind to CD16, CD32, or CD64, suggesting that it is inert to any Fc-FcR mediated effector function. TIM3.18.IgG1.3 has good thermal stability (Tm1=68.1° C., Tm2=80.3° C., Tm3=82.6° C.) and thermal reversibility (95.6% at 74° C., 25.5% at 80° C.), which suggest that the molecule retains its structural integrity under thermal stress and has robust refolding properties when stress is released.

Stability characteristics of TIM3.18.IgG1.3 are provided in Table 5.

TABLE 5

Stability of TIM3.18.IgG1.3

| Property | Method(s) | Results |
|---|---|---|
| Freeze/Thaw (1 h @ −80° C., 1 h @ RT × 6) | UV, SEC | No freeze/thaw stability risk revealed |
| Solubility/Concentration Profile | UV, SEC | At least 60 mg/mL |
| Accelerated Stability 50 mg/mL 12 w @ 4° C., 25° C., and 40° C. in the platform formulation | SEC, DLS, HIC, cIEF LC-MS/MS peptide mapping | 12 w @ 40° C. = 2%/month increase in LMW |
| | | 12 w @ 40° C. < 1% increase in HMW |
| | | 12 w @ 40° C. = 18%/month increase in acidic variants |

No physical stability issues were observed during freeze-thaw stress (6 cycles) at 50 mg/mL. Forced degradation studies at 50 mg/mL were set up at 4, 25, and 40° C. No chemical modifications in the CDR region were observed over 12 weeks under any condition tested.

The potential immunogenicity risk of TIM3.18.IgG1.3 was evaluated by in silico methods. The in silico iDAB analysis of TIM3.18.IgG1.3 showed few potential HLA binding sequences in the CDRs of this mAb, indicating a low risk of inducing a human immune response.

Example 19: PK/PD of TIM3.18.IgG1.3 in Monkeys

In a single-dose PK/PD and tolerability study, all monkeys were immunized intramuscularly with 2.5 mg of key-hole limpet hemocyanin (KLH) and nonproliferative recombinant adenovirus-5 (Ad5) vectors expressing simian immunodeficiency virus (SIV) Nef and Gag proteins ($3 \times 10^9$ of each vector). Following immunization, monkeys were intravenously administered TIM3.18.IgG1.3 at doses of 0 (vehicle), 0.5, 10, or 25 mg/kg (N=3/group; mixed sex). Serum samples were collected for up to 42 days for the assessment of pharmacokinetics (PK) and anti-drug antibody (ADA), and blood samples were collected for up to 42 days for assessment of receptor occupancy. Additional serum samples were reserved for other exploratory endpoints including soluble TIM3 levels.

$AUC_{0-168\,h}$ was dose proportional from 0.5 to 25 mg/kg. TIM3.18.IgG1.3 demonstrated a $T_{1/2}$ of about 2 weeks and total serum clearance of 0.18 mL/h/kg. Volume of distribution at the steady state ranged from 68 to 84 mL/kg, suggesting that TIM3.18.IgG1.3 predominantly resides in the extracellular space (Table 6).

TABLE 6

Pharmacokinetic Parameters of TIM3.18.IgG1.3 after IV Administration in Cynomolgus Monkeys

| Monkey number | Dose (mg/kg) | $AUC_{(0-inf)}$ (µM × h) | $T_{1/2}$ (h) | CLT (mL/h/kg) | $V_{SS}$ (mL/kg) |
|---|---|---|---|---|---|
| 3 | 0.5 | NC | NC | NC | NC |
| 3 | 10 | 358 ± 90* | 337 ± 91 | 0.19 ± 0.047 | 84 ± 3.8 |
| 3 | 25 | 1076 ± 324 | 321 ± 104 | 0.17 ± 0.053 | 68 ± 7.4 |

*Extrapolated AUC exceeded 20% cutoff and ranged from 21% to 55%.

Based on PK in cynomolgus monkeys and allometric scaling, the projected human total serum clearance is 0.10 mL/h/kg and Vss of 88 mL/kg. As a result, the projected human half-life is about 26 days.

Example 20: Preliminary Cytokine Release Assay

To determine if treatment with TIM3.18.IgG1.3 poses a risk of cytokine release syndrome, whole blood from 16 human donors was incubated with 20 μg/mL of TIM3.18.IgG1.3 or positive controls in solution. A panel of 75 serum cytokines and chemokines was examined for each donor. There was no evidence of enhanced T-cell-derived cytokine or chemokine release, suggesting a low risk of cytokine release syndrome. In whole blood assays from some donors, there was elevation of IL-1β, IL-6, IL-10, TNF-α, and G-CSF, consistent with evidence presented above that TIM3 blockade increases production of monocyte or macrophage-derived cytokines. (Data not shown).

Example 21: TIM3.18.IgG1.3 does not Cause Receptor Downregulation or Internalization To determine whether 13A3 downregulates or internalizes human TIM3 on the cell membrane when binding to it, the fluorescence quenching study shown in FIG. 43 was conducted. The results after a 3 hour treatment, which are shown in FIG. 44, indicate that neither 13A3 antibody nor variants D101E or N60Q caused dose-dependent accumulation of intra-cellular TIM3 antibody in activated donor CD8$^+$ T cells, suggesting that the antibody is not internalized.

For determining potential downregulation, activated donor CD8+ T cells were incubated for 2 hours in the presence of various amounts of 13A3, 13A3.D101.Ig1.1f, 13A3.D101E/N60Q.IgG1.1f or a control antibody or no antibody, and the amount of TIM3 on the cell surface was determined. The results indicated that incubation with the anti-TIM3 antibodies did not downregulate cell surface TIM3 expression.

Example 22: Binding affinity of TIM3.24 and TIM3.25 antibodies to human and cyno TIM3

The binding affinity of TIM3.24 (14H7) and TIM3.25 (23B3 VH-G6E-D79Y) to human and cyno TIM3 was determined as follows. Human TIM3-IgV (0.63 g/L), cyno TIM3-IgV (0.5 g/L) and cyno TIM3-ECD (0.3 g/L) were used in the following method: Biacore T200, 37° C., running buffer HBS pH 7.4 supplemented with 0.05% Tween-20 and 1 g/L BSA. CM4 chip with immobilized Jackson anti-hFc pAb (cat #109-005-098), blocked with EDA, was used.

Antibodies were captured on flow cells 2, 3, and 4. Flow cell 1 served as a reference. Human and cyno TIM3 proteins were injected in a 5-membered, 5-fold dilution series with 250 nM nominal top concentration using the single cycle kinetics option. All data were double-referenced and fitted to a 1:1 binding model with transport limitation.

The results are provided below:

TABLE 7

| | | | | | | |
|---|---|---|---|---|---|---|
| Binding Affinity | | | | | | |
| Biacore, 37 C. | | | hTim3-IgV | | | cyTim3-IgV |
| Ligand | Real Ligand name | Sample | ka (1/Ms) | kd (1/s) | KD (M) | ka (1/Ms) |
| Tim3.18 | 13A3 VH-N60Q-D101E | hTim3-IgV | 6.2E+05 | 4.4E−03 | 7.1E−09 | 1.1E+05 |
| Tim3.24 | 14H7 | hTim3-IgV | 7.8E+05 | 1.1E−02 | 1.4E−08 | 1.2E+06 |
| Tim3.25 | 23B3 VH-G6E-D79Y | hTim3-IgV | 6.0E+05 | 1.3E−03 | 2.2E−09 | 8.4E+09 |

| | cyTim3-IgV | | cyTim3-ECD | | | KD ratio cy Tim3-IgV/ |
|---|---|---|---|---|---|---|
| Biacore, 37 C. | | | | | | |
| Ligand | kd (1/s) | KD (M) | ka (1/Ms) | kd (1/s) | KD (M) | hTim3-IgV |
| Tim3.18 | 4.0E−02 | 4.1E−08 | 5.2E+05 | 3.5E−02 | 6.8E−08 | 5.8 |
| Tim3.24 | 2.7E−03 | 2.5E−09 | 6.5E+05 | 2.7E−03 | 4.3E−09 | 0.18 |
| Tim3.25 | 6.2E−02 | 8.4E−08 | 3.8E+09 | 5.1E−02 | 1.4E−07 | 39 |

The results indicate the following:
- TIM3.24 (14H7) binds to cyTIM3 with higher affinity than to hTIM3 in this assay.
- 13A3 and 23B3 variants (TIM3.18 and TIM3.25, respectively) bind to hTIM3 with higher affinity than to cyTIM3. The affinity difference for TIM3.18 is moderate (5×), and that for TIM3.25 is strong (39×).
- Binding to the full length cyno ECD was about 2× slower than binding to the cyno IgV domain for all three antibodies, probably driven by size, possibly also by different sample activity. Offrates were very similar despite some non-specific binding observed for cyTim3-IgV.

Example 23: Anti-TIM3 Antibodies that do not Cross-Compete with TIM3.18 for Binding to hTIM3 and does not Prevent hTIM3-PS Interaction An antibody that binds to an area of hTIM3 that is different from that bound by TIM3.18, TIM3.24 and TIM3.25 was identified. This antibody was referred to as 5D6 ("TIM3.20"). Antibodies in which N30S mutation was introduced into the heavy chain were also made ("TIM3.22"). Antibodies were made in the context of an IgG1f and IgG1.3f isotype. These antibodies were also made with an alternative light chain, comprising SEQ ID NO: 63 (VK2), and referred to as TIM3.21 (5D6 VK2) and TIM3.23 (5D6VH_N30S VK2) but they were not found to bind to hTIM3.

Antibodies TIM3.20 and TIM3.22 were used in a cross-compete assay and determined not to compete for binding to hTIM3 with TIM3.18. In addition, TIM3.20 and TIM3.22 do not prevent hTIM3 from binding to phosphatidylserine (PS), and have low Th1 stimulating activity (relative to that of TIM3.18). Thus, TIM3.20 and TIM3.22 bind to an epitope on hTIM3 that is different from that bound by TIM3.18, and is less active in T cell stimulation.

This PCT application claims priority benefit of U.S. Provisional Application No. 62/616,723, filed Jan. 12, 2018, which is incorporated herein by reference in its entirety.

SEQUENCE LISTING (448 sequences)

SEQ ID NO: 1 - protein, 453 aa, Artificial Sequence
  13A3IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 447 aa, Artificial Sequence
  8B9IgG1.1f HC
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - protein, 447 aa, Artificial Sequence
  8C4IgG1.1f HC
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4 - protein, 453 aa, Artificial Sequence
  17C3IgG1.1f HC
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 453 aa, Artificial Sequence
  9F6IgG1.1f HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6 - protein, 454 aa, Artificial Sequence
  3G4IgG1.1f HC
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7 - protein, 453 aa, Artificial Sequence
  17C8IgG1.1f HC
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8 - protein, 452 aa, Artificial Sequence
  13A3IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 9 - protein, 446 aa, Artificial Sequence
  8B9IgG1.1f HC (no C-terminal K)
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10 - protein, 446 aa, Artificial Sequence
  8C4IgG1.1f HC (no C-terminal K)
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 11 - protein, 452 aa, Artificial Sequence
  17C3IgG1.1f HC (no C-terminal K)
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 12 - protein, 452 aa, Artificial Sequence
  9F6IgG1.1f HC (no C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 13 - protein, 453 aa, Artificial Sequence
  3G4IgG1.1f HC (no C-terminal K)
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 14 - protein, 452 aa, Artificial Sequence
  17C8IgG1.1f HC (no C-terminal K)
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 15 - protein, 453 aa, Artificial Sequence
  13A3IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - protein, 447 aa, Artificial Sequence
  8B9IgG1.3f HC
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - protein, 447 aa, Artificial Sequence
  8C4IgG1.3f HC
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 453 aa, Artificial Sequence
  17C3IgG1.3f HC
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - protein, 453 aa, Artificial Sequence
  9F6IgG1.3f HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 454 aa, Artificial Sequence
  3G4IgG1.3f HC
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - protein, 453 aa, Artificial Sequence
  17C8IgG1.3f HC
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 452 aa, Artificial Sequence
  13A3IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 23 - protein, 446 aa, Artificial Sequence
  8B9IgG1.3f HC (no C-terminal K)
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 24 - protein, 446 aa, Artificial Sequence
  8C4IgG1.3f HC (no C-terminal K)
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 25 - protein, 452 aa, Artificial Sequence
  17C3IgG1.3f HC (no C-terminal K)
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 26 - protein, 452 aa, Artificial Sequence
  9F6IgG1.3f HC (no C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 27 - protein, 453 aa, Artificial Sequence
  3G4IgG1.3f HC (no C-terminal K)
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 28 - protein, 452 aa, Artificial Sequence
  17C8IgG1.3f HC (no C-terminal K)
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 29 - protein, 215 aa, Artificial Sequence
  13A3, 17C3, 3G4, 23B3, TIM3.25 LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 30 - protein, 215 aa, Artificial Sequence
  8B9, 8C4, 17C8 LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - protein, 215 aa, Artificial Sequence; identical to SEQ ID NO: 30
  9F6 (VK3)LC

SEQ ID NO: 32 - protein, 214 aa, Artificial Sequence
  9F6 (VK1) LC
AIQLTQSPSSLSASVGDRVTITCRASQGISSALAWYQQKPGKAPKLLIYDASSLESGVPSRFSGSGSGTDFTLTISSLQPEDFATYYCQQFNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 33 - protein, 214 aa, Artificial Sequence
  9F6 (VK2)LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 34 - protein, 123 aa, Artificial Sequence
  13A3VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSS

SEQ ID NO: 35 - protein, 117 aa, Artificial Sequence
  8B9VH
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSS

SEQ ID NO: 36 - protein, 117 aa, Artificial Sequence
  8C4VH
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSS

SEQ ID NO: 37 - protein, 123 aa, Artificial Sequence
  17C3VH
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSS

SEQ ID NO: 38 - protein, 123 aa, Artificial Sequence
  9F6VH
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSS

SEQ ID NO: 39 - protein, 124 aa, Artificial Sequence
  3G4VH
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSS

SEQ ID NO: 40 - protein, 123 aa, Artificial Sequence
  17C8VH
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSS

SEQ ID NO: 41 - protein, 7 aa, Artificial Sequence
  13A3,  including the following 13A3 variants: N60Q; N60S; N60A; D101E; P102V; P102Y; P102L; N60Q and P102Y; N60Q and D101ECDR1 (VH)
  D101E; P102V; P102Y; P102L; N60Q and P102Y; N60Q and D101ECDR1 (VH)
SRSYYWG

SEQ ID NO: 42 - protein, 5 aa, Artificial Sequence
  8B9, including the 8B9 (S61P) variantCDR1 (VH)
RHYWN

SEQ ID NO: 43 - protein, 5 aa, Artificial Sequence
  8C4CDR1 (VH)
RYYWS

SEQ ID NO: 44 - protein, 5 aa, Artificial Sequence
  17C3CDR1 (VH)
SYYMH

SEQ ID NO: 45 - protein, 5 aa, Artificial Sequence
  9F6, including the 9F6 (A108T) variant, 3G4
  17C8, 14H7, TIM3.24, 23B3, TIM3.25 CDR1 (VH)
DYYMS

SEQ ID NO: 46 - protein, 16 aa, Artificial Sequence
  13A3, including the following 13A3 variants: D101E
  P102V, P102Y, and P102LCDR2 (VH)
SIYYSGFTYYNPSLKS

SEQ ID NO: 47 - protein, 16 aa, Artificial Sequence
  8B9CDR2 (VH)
YIHYSGSTNYNSSLKS

SEQ ID NO: 48 - protein, 16 aa, Artificial Sequence
  8C4CDR2 (VH)
YIHYTGSTNYNPSLKS

SEQ ID NO: 49 - protein, 17 aa, Artificial Sequence
  17C3CDR2 (VH)
IINPRGDSIIYAQKFQG

SEQ ID NO: 50 - protein, 17 aa, Artificial Sequence
  9F6, including the 9F6 (A108T) variantCDR2 (VH)
FISGGGSTIYYADSVKG

SEQ ID NO: 51 - protein, 17 aa, Artificial Sequence
  3G4CDR2 (VH)
FISTSGSIIYYADSVKG

SEQ ID NO: 52 - protein, 17 aa, Artificial Sequence
  17C8CDR2 (VH)
FISSSGSIIYYADSVKG

SEQ ID NO: 53 - protein, 13 aa, Artificial Sequence
  13A3, including the following 13A3 variants: N60Q, N60S, N60ACDR3 (VH)
GGPYGDYAHWFDP

SEQ ID NO: 54 - protein, 9 aa, Artificial Sequence
  8B9, including the 8B9 (S61P) variantCDR3 (VH)
DTGYYGMDI

SEQ ID NO: 55 - protein, 9 aa, Artificial Sequence
  8C4CDR3 (VH)
DTGYYGMDV

SEQ ID NO: 56 - protein, 14 aa, Artificial Sequence
  17C3CDR3 (VH)
DFYGSGNYYYGMDV

SEQ ID NO: 57 - protein, 14 aa, Artificial Sequence
  9F6, including the 9F6 (A108T) variantCDR3 (VH)
DGYSSGWYYYGMDV

SEQ ID NO: 58 - protein, 15 aa, Artificial Sequence
  3G4CDR3 (VH)
EGYSSSWSYYYGMDV

SEQ ID NO: 59 - protein, 14 aa, Artificial Sequence
  17C8CDR3 (VH)
DGYSSGWEYYGMDV

SEQ ID NO: 60 - protein, 108 aa, Artificial Sequence
  13A3, 17C3, 3G4, 23B3 (VK1), TIM3.25 VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIK

SEQ ID NO: 61 - protein, 108 aa, Artificial Sequence
  8B9, 8C4, 17C8, 9F6 (VK3) VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 62 - protein, 107 aa, Artificial Sequence
  9F6 (VK1) VL
AIQLTQSPSSLSASVGDRVTITCRASQGISSALAWYQQKPGKAPKLLIYDASSLESGVPSRFSGSGSGTDFTLTISSLQPEDFATYYCQQFNSYPRTFGQGTKVEIK

SEQ ID NO: 63 - protein, 107 aa, Artificial Sequence
  9F6 (VK2)VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIK

SEQ ID NO: 64 - protein, 12 aa, Artificial Sequence
  13A3, 8B9, 8C4, 17C3, 9F6 (VK2, VK3), 3G4
  17C8, 14H7, TIM3.24, 23B3, TIM3.25 CDR1 (VL)
RASQSVSSSYLA

SEQ ID NO: 65 - protein, 11 aa, Artificial Sequence
  9F6 (VK1) CDR1 (VL)
RASQGISSALA

SEQ ID NO: 66 - protein, 7 aa, Artificial Sequence
  13A3, 8B9, 8C4, 17C3, 9F6 (VK2, VK3), 3G4
  17C8, 14H7, TIM3.24, 23B3, TIM3.25 CDR2 (VL)
GASSRAT

SEQ ID NO: 67 - protein, 7 aa, Artificial Sequence
  9F6 (VK1) CDR2 (VL)
DASSLES

SEQ ID NO: 68 - protein, 9 aa, Artificial Sequence
  13A3, 17C3, 3G4, 23B3 (VK1), TIM3.25CDR3 (VL)
QQYGSSPIT

SEQ ID NO: 69 - protein, 9 aa, Artificial Sequence
  8B9, 8C4, 9F6 (VK3), 17C8, 14H7, TIM3.24CDR3 (VL)
QQYGSSPLT

SEQ ID NO: 70 - protein, 9 aa, Artificial Sequence
  9F6 (VK1)CDR3 (VL)
QQFNSYPRT

SEQ ID NO: 71 - protein, 8 aa, Artificial Sequence
  9F6 (VK2)CDR3 (VL)
QQYGSSLT

SEQ ID NO: 72 - protein, 453 aa, Artificial Sequence
  13A3 (N60Q)IgG1.1f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 453 aa, Artificial Sequence
  13A3 (N60S)IgG1.1f HC
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 453 aa, Artificial Sequence
  13A3 (N60A)IgG1.1f HC
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 453 aa, Artificial Sequence
  13A3 (D101E)IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 453 aa, Artificial Sequence
  13A3 (P102V)IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 453 aa, Artificial Sequence
  13A3 (P102Y)IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 453 aa, Artificial Sequence
  13A3 (P102L)IgG1.1f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 453 aa, Artificial Sequence
  13A3 (N60Q, P102Y)IgG1.1f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 447 aa, Artificial Sequence
  8B9 (S61P)IgG1.1f HC
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 453 aa, Artificial Sequence
  9F6 (A108T)IgG1.1f HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 452 aa, Artificial Sequence
  13A3 (N60Q)IgG1.1f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 83 - protein, 452 aa, Artificial Sequence
  13A3 (N60S)IgG1.1f HC (no C-terminal K)
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 84 - protein, 452 aa, Artificial Sequence
  13A3 (N60A)IgG1.1f HC (no C-terminal K)
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 85 - protein, 452 aa, Artificial Sequence
  13A3 (D101E)IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 86 - protein, 452 aa, Artificial Sequence
  13A3 (P102V)IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 87 - protein, 452 aa, Artificial Sequence
  13A3 (P102Y)IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 88 - protein, 452 aa, Artificial Sequence
  13A3 (P102L)IgG1.1f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 89 - protein, 452 aa, Artificial Sequence
  13A3 (N60Q, P102Y)IgG1.1f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 90 - protein, 446 aa, Artificial Sequence
  8B9 (S61P)IgG1.1f HC (no C-terminal K)
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 91 - protein, 452 aa, Artificial Sequence
  9F6 (A108T)IgG1.1f HC (no C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 92 - protein, 453 aa, Artificial Sequence
  13A3 (N60Q)IgG1.3f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 453 aa, Artificial Sequence
  13A3 (N60S)IgG1.3f HC
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 453 aa, Artificial Sequence
  13A3 (N60A)IgG1.3f HC
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 453 aa, Artificial Sequence
  13A3 (D101E)IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 453 aa, Artificial Sequence
  13A3 (P102V)IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 453 aa, Artificial Sequence
  13A3 (P102Y)IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 453 aa, Artificial Sequence
  13A3 (P102L)IgG1.3f HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 453 aa, Artificial Sequence
  13A3 (N60Q, P102Y)IgG1.3f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 447 aa, Artificial Sequence
  8B9 (S61P)IgG1.3f HC
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 453 aa, Artificial Sequence
  9F6 (A108T)IgG1.3f HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 452 aa, Artificial Sequence
  13A3 (N60Q)IgG1.3f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 103 - protein, 452 aa, Artificial Sequence
  13A3 (N60S)IgG1.3f HC (no C-terminal K)
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 104 - protein, 452 aa, Artificial Sequence
  13A3 (N60A)IgG1.3f HC (no C-terminal K)
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 105 - protein, 452 aa, Artificial Sequence
  13A3 (D101E)IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 106 - protein, 452 aa, Artificial Sequence
  13A3 (P102V)IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 107 - protein, 452 aa, Artificial Sequence
  13A3 (P102Y)IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 108 - protein, 452 aa, Artificial Sequence
  13A3 (P102L)IgG1.3f HC (no C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 109 - protein, 452 aa, Artificial Sequence
  13A3 (N60Q, P102Y)IgG1.3f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 110 - protein, 446 aa, Artificial Sequence
  8B9 (S61P)IgG1.3f HC (no C-terminal K)
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 111 - protein, 452 aa, Artificial Sequence
  9F6 (A108T)IgG1.3f HC (no C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 112 - protein, 123 aa, Artificial Sequence
  13A3 (N60Q)VH
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSS

SEQ ID NO: 113 - protein, 123 aa, Artificial Sequence
  13A3 (N60S)VH
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSS

SEQ ID NO: 114 - protein, 123 aa, Artificial Sequence
  13A3 (N60A)VH
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSS

SEQ ID NO: 115 - protein, 123 aa, Artificial Sequence
  13A3 (D101E)VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSS

SEQ ID NO: 116 - protein, 123 aa, Artificial Sequence
  13A3 (P102V)VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSS

SEQ ID NO: 117 - protein, 123 aa, Artificial Sequence
  13A3 (P102Y)VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSS

SEQ ID NO: 118 - protein, 123 aa, Artificial Sequence
  13A3 (P102L)VH
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSS

SEQ ID NO: 119 - protein, 123 aa, Artificial Sequence
  13A3 (N60Q, P102Y)VH
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSS

SEQ ID NO: 120 - protein, 117 aa, Artificial Sequence
  8B9 (S61P)VH
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSS

SEQ ID NO: 121 - protein, 123 aa, Artificial Sequence
  9F6 (A108T)VH
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSS

SEQ ID NO: 122 - protein, 16 aa, Artificial Sequence
  13A3 (N60Q); 13A3 (N60Q, P102Y); 13A3 (N60Q, D101E)CDR2 (VH)
SIYYSGFTYYQPSLKS

SEQ ID NO: 123 - protein, 16 aa, Artificial Sequence
  13A3 (N60S)CDR2 (VH)
SIYYSGFTYYSPSLKS

SEQ ID NO: 124 - protein, 16 aa, Artificial Sequence
  13A3 (N60A)CDR2 (VH)
SIYYSGFTYYAPSLKS

SEQ ID NO: 125 - protein, 16 aa, Artificial Sequence
  8B9 (S61P)CDR2 (VH)
YIHYSGSTNYNPSLKS

SEQ ID NO: 126 - protein, 13 aa, Artificial Sequence
  13A3 (D101E); 13A3 (N60Q, D101E)CDR3 (VH)
GGPYGDYAHWFEP

SEQ ID NO: 127 - protein, 13 aa, Artificial Sequence
  13A3 (P102V)CDR3 (VH)
GGPYGDYAHWFDV

SEQ ID NO: 128 - protein, 13 aa, Artificial Sequence
  13A3 (P102Y); 13A3 (N60Q, P102Y)CDR3 (VH)
GGPYGDYAHWFDY

SEQ ID NO: 129 - protein, 13 aa, Artificial Sequence
  13A3 (P102L)CDR3 (VH)
GGPYGDYAHWFDL

SEQ ID NO: 130 - protein, 330 aa, Artificial Sequence
  All antibodiesHC Constant Domain (IgG1.1f)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 329 aa, Artificial Sequence
  All antibodiesHC Constant Domain (IgG1.1f) (no C-terminal K)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 132 - protein, 330 aa, Artificial Sequence
  All antibodiesHC Constant Domain (IgG1.3f)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - protein, 329 aa, Artificial Sequence
  All antibodiesHC Constant Domain (IgG1.3f) (no C-terminal K)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 134 - DNA, 1362 bp, Artificial Sequence
  13A3IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 135 - DNA, 1344 bp, Artificial Sequence
  8B9IgG1.1f HC
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaattcctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 136 - DNA, 1344 bp, Artificial Sequence
  8C4IgG1.1f HC
caggtgcagctgcaggagtcgggcccaggactggtgaagccttcggagaccctgtccctcacctgcactgtctctggtggctccatcagtcgttactactggagctggatccggcagcccccagggaagggactggagtggattgggtatatccattacactgggagcaccaactacaacccctccctcaagagtcgagtcaccatatcagtagacacgtccaagaaccagttctccctgaagctgagctctgtgaccgcagcggacacggccgtgtattactgtgcgacagatacgggctactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 137 - DNA, 1362 bp, Artificial Sequence
  17C3IgG1.1f HC
caggtgcagttggtgcagtctggggctgaggtgaagaagcctggggcctcagtgaaggtctcctgcaaggcatctggatacactttcaccagctactatatgcactgggtgcgacaggcccctggacaagggcttgagtggatgggaataatcaaccctaggggtgatagcataatctacgcacagaagttccagggcagagtcaccatgaccagggacacgtccacgagcacagtctacatggagctgagcagcctgagatctgaggacacggccgtgtattactgtgcgagagatttctatggttcgggaaactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 138 - DNA, 1362 bp, Artificial Sequence
  9F6IgG1.1f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccgcggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 139 - DNA, 1365 bp, Artificial Sequence
  3G4IgG1.1f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtactagtggtagtatcatatactacgcagactctgtgaagggccgattcaccatctccagggacaacgccaagaactcactgtatctgcaaatgaacagcctgagagccgaggacacggctgtgtattactgtgcgagagaagggtatagcagcagctggtcctactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 140 - DNA, 1362 bp, Artificial Sequence
  17C8IgG1.1f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtagtagtggtagtatcatatactacgcagactctgtgaagggccgattcaccatctccagggacaacgccaagaactcactgtatctgcaaatgaacagcctgagagccgaggacacggctgtgtattactgtgcgagagatgggtatagcagtggctgggagtactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 141 - DNA, 1359 bp, Artificial Sequence
  13A3IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 142 - DNA, 1341 bp, Artificial Sequence
  8B9IgG1.1f HC (no C-terminal K)
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaattcctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 143 - DNA, 1341 bp, Artificial Sequence
  8C4IgG1.1f HC (no C-terminal K)
caggtgcagctgcaggagtcgggcccaggactggtgaagccttcggagaccctgtccctcacctgcactgtctctggtggctccatcagtcgttactactggagctggatccggcagcccccagggaagggactggagtggattgggtatatccattacactgggagcaccaactacaacccctccctcaagagtcgagtcaccatatcagtagacacgtccaagaaccagttctccctgaagctgagctctgtgaccgcagcggacacggccgtgtattactgtgcgacagatacgggctactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 144 - DNA, 1359 bp, Artificial Sequence
  17C3IgG1.1f HC (no C-terminal K)
caggtgcagttggtgcagtctggggctgaggtgaagaagcctggggcctcagtgaaggtctcctgcaaggcatctggatacactttcaccagctactatatgcactgggtgcgacaggcccctggacaagggcttgagtggatgggaataatcaaccctaggggtgatagcataatctacgcacagaagttccagggcagagtcaccatgaccagggacacgtccacgagcacagtctacatggagctgagcagcctgagatctgaggacacggccgtgtattactgtgcgagagatttctatggttcgggaaactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 145 - DNA, 1359 bp, Artificial Sequence
  9F6IgG1.1f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccgcggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 146 - DNA, 1362 bp, Artificial Sequence
  3G4IgG1.1f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtactagtggtagtatcatatactacgcagactctgtgaagggccgattcaccatctccagggacaacgccaagaactcactgtatctgcaaatgaacagcctgagagccgaggacacggctgtgtattactgtgcgagagaagggtatagcagcagctggtcctactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 147 - DNA, 1359 bp, Artificial Sequence
  17C8IgG1.1f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtagtagtggtagtatcatatactacgcagactctgtgaagggccgattcaccatctccagggacaacgccaagaactcactgtatctgcaaatgaacagcctgagagccgaggacacggctgtgtattactgtgcgagagatgggtatagcagtggctgggagtactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 148 - DNA, 1362 bp, Artificial Sequence
  13A3IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 149 - DNA, 1343 bp, Artificial Sequence
  8B9IgG1.3f HC
aggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaattcctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 150 - DNA, 1344 bp, Artificial Sequence
  8C4IgG1.3f HC
caggtgcagctgcaggagtcgggcccaggactggtgaagccttcggagaccctgtccctcacctgcactgtctctggtggctccatcagtcgttactactggagctggatccggcagcccccagggaagggactggagtggattgggtatatccattacactgggagcaccaactacaacccctccctcaagagtcgagtcaccatatcagtagacacgtccaagaaccagttctccctgaagctgagctctgtgaccgcagcggacacggccgtgtattactgtgcgacagatacgggctactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 151 - DNA, 1362 bp, Artificial Sequence
  17C3IgG1.3f HC
caggtgcagttggtgcagtctggggctgaggtgaagaagcctggggcctcagtgaaggtctcctgcaaggcatctggatacactttcaccagctactatatgcactgggtgcgacaggcccctggacaagggcttgagtggatgggaataatcaaccctaggggtgatagcataatctacgcacagaagttccagggcagagtcaccatgaccagggacacgtccacgagcacagtctacatggagctgagcagcctgagatctgaggacacggccgtgtattactgtgcgagagatttctatggttcgggaaactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 152 - DNA, 1362 bp, Artificial Sequence
  9F6IgG1.3f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccgcggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 153 - DNA, 1365 bp, Artificial Sequence
  3G4IgG1.3f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtactagtggtagtatcatatactacgcagactctgtgaagggccgattcaccatctccagggacaacgccaagaactcactgtatctgcaaatgaacagcctgagagccgaggacacggctgtgtattactgtgcgagagaagggtatagcagcagctggtcctactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 154 - DNA, 1362 bp, Artificial Sequence
  17C8IgG1.3f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtagtagtggtagtatcatatactacgcagactctgtgaagggccgattcaccatctccagggacaacgccaagaactcactgtatctgcaaatgaacagcctgagagccgaggacacggctgtgtattactgtgcgagagatgggtatagcagtggctgggagtactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 155 - DNA, 1359 bp, Artificial Sequence
  13A3IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 156 - DNA, 1340 bp, Artificial Sequence
  8B9IgG1.3f HC (no C-terminal K)
aggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaattcctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 157 - DNA, 1341 bp, Artificial Sequence
  8C4IgG1.3f HC (no C-terminal K)
caggtgcagctgcaggagtcgggcccaggactggtgaagccttcggagaccctgtccctcacctgcactgtctctggtggctccatcagtcgttactactggagctggatccggcagcccccagggaagggactggagtggattgggtatatccattacactgggagcaccaactacaacccctccctcaagagtcgagtcaccatatcagtagacacgtccaagaaccagttctccctgaagctgagctctgtgaccgcagcggacacggccgtgtattactgtgcgacagatacgggctactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 158 - DNA, 1359 bp, Artificial Sequence
  17C3IgG1.3f HC (no C-terminal K)
caggtgcagttggtgcagtctggggctgaggtgaagaagcctggggcctcagtgaaggtctcctgcaaggcatctggatacactttcaccagctactatatgcactgggtgcgacaggcccctggacaagggcttgagtggatgggaataatcaaccctaggggtgatagcataatctacgcacagaagttccagggcagagtcaccatgaccagggacacgtccacgagcacagtctacatggagctgagcagcctgagatctgaggacacggccgtgtattactgtgcgagagatttctatggttcgggaaactactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 159 - DNA, 1359 bp, Artificial Sequence
  9F6IgG1.3f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccgcggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 160 - DNA, 1362 bp, Artificial Sequence
  3G4IgG1.3f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtactagtggtagtatcatatactacgcagactctgtgaagggccgattcaccatctccagggacaacgccaagaactcactgtatctgcaaatgaacagcctgagagccgaggacacggctgtgtattactgtgcgagagaagggtatagcagcagctggtcctactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 161 - DNA, 1359 bp, Artificial Sequence
  17C8IgG1.3f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtagtagtggtagtatcatatactacgcagactctgtgaagggccgattcaccatctccagggacaacgccaagaactcactgtatctgcaaatgaacagcctgagagccgaggacacggctgtgtattactgtgcgagagatgggtatagcagtggctgggagtactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 162 - DNA, 648 bp, Artificial Sequence
  13A3, 17C3, 3G4, TIM3.25 LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 163 - DNA, 648 bp, Artificial Sequence
  8B9, 8C4, 17C8 LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 164 - DNA, 648 bp, Artificial Sequence
  9F6 (VK3)LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 165 - DNA, 645 bp, Artificial Sequence
  9F6 (VK1) LC
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 166 - DNA, 645 bp, Artificial Sequence
  9F6 (VK2)LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 167 - DNA, 369 bp, Artificial Sequence
  13A3VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctca

SEQ ID NO: 168 - DNA, 351 bp, Artificial Sequence
  8B9VH
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaattcctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctca

SEQ ID NO: 169 - DNA, 351 bp, Artificial Sequence
  8C4VH
caggtgcagctgcaggagtcgggcccaggactggtgaagccttcggagaccctgtccctcacctgcactgtctctggtggctccatcagtcgttactactggagctggatccggcagcccccagggaagggactggagtggattgggtatatccattacactgggagcaccaactacaacccctccctcaagagtcgagtcaccatatcagtagacacgtccaagaaccagttctccctgaagctgagctctgtgaccgcagcggacacggccgtgtattactgtgcgacagatacgggctactacggtatggacgtctggggccaagggaccacggtcaccgtctcctca

SEQ ID NO: 170 - DNA, 369 bp, Artificial Sequence
  17C3VH
caggtgcagttggtgcagtctggggctgaggtgaagaagcctggggcctcagtgaaggtctcctgcaaggcatctggatacactttcaccagctactatatgcactgggtgcgacaggcccctggacaagggcttgagtggatgggaataatcaaccctaggggtgatagcataatctacgcacagaagttccagggcagagtcaccatgaccagggacacgtccacgagcacagtctacatggagctgagcagcctgagatctgaggacacggccgtgtattactgtgcgagagatttctatggttcgggaaactactactacggtatggacgtctggggccaagggaccacggtcaccgtctcctca

SEQ ID NO: 171 - DNA, 375 bp, Artificial Sequence
  9F6VH
cagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccgcggtcaccgtctcctca

SEQ ID NO: 172 - DNA, 378 bp, Artificial Sequence
  3G4VH
cagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtactagtggtagtatcatatactacgcagactctgtgaagggccgattcaccatctccagggacaacgccaagaactcactgtatctgcaaatgaacagcctgagagccgaggacacggctgtgtattactgtgcgagagaagggtatagcagcagctggtcctactactacggtatggacgtctggggccaagggaccacggtcaccgtctcctca

SEQ ID NO: 173 - DNA, 375 bp, Artificial Sequence
  17C8VH
cagtgtcaggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtagtagtggtagtatcatatactacgcagactctgtgaagggccgattcaccatctccagggacaacgccaagaactcactgtatctgcaaatgaacagcctgagagccgaggacacggctgtgtattactgtgcgagagatgggtatagcagtggctgggagtactacggtatggacgtctggggccaagggaccacggtcaccgtctcctca

SEQ ID NO: 174 - DNA, 21 bp, Artificial Sequence
  13A3, including the following 13A3 variants: N60Q; N60S; N60A; D101E
  P102V; P102Y; P102L; N60Q and P102Y; 13A3 (N60Q, D101E)CDR1 (VH)
agtagaagttactactggggc

SEQ ID NO: 175 - DNA, 15 bp, Artificial Sequence
  8B9, including the 8B9 (S61P) variantCDR1 (VH)
cgtcactactggaac

SEQ ID NO: 176 - DNA, 15 bp, Artificial Sequence
  8C4CDR1 (VH)
cgttactactggagc

SEQ ID NO: 177 - DNA, 15 bp, Artificial Sequence
  17C3CDR1 (VH)
agctactatatgcac

SEQ ID NO: 178 - DNA, 15 bp, Artificial Sequence
  9F6, including the 9F6 (A108T) variant
  3G4, 17C8, 14H7, TIM3.24, 23B3, TIM3.25 CDR1 (VH)
gactactacatgagc

SEQ ID NO: 179 - DNA, 48 bp, Artificial Sequence
  13A3, including the following 13A3 variants: D101E
  P102V, P102Y, and P102LCDR2 (VH)
agtatctattatagtgggttcacctactacaacccgtccctcaagagt

SEQ ID NO: 180 - DNA, 48 bp, Artificial Sequence
  8B9CDR2 (VH)
tatatccattacagtggaagcaccaactacaattcctccctcaagagt

SEQ ID NO: 181 - DNA, 48 bp, Artificial Sequence
  8C4CDR2 (VH)
tatatccattacactgggagcaccaactacaacccctccctcaagagt

SEQ ID NO: 182 - DNA, 51 bp, Artificial Sequence
  17C3CDR2 (VH)
ataatcaaccctaggggtgatagcataatctacgcacagaagttccagggc

SEQ ID NO: 183 - DNA, 51 bp, Artificial Sequence
  9F6, including the 9F6 (A108T) variantCDR2 (VH)
ttcattagtggtggtggtagtaccatatactacgcagactctgtgaagggc

SEQ ID NO: 184 - DNA, 51 bp, Artificial Sequence
  3G4CDR2 (VH)
ttcattagtactagtggtagtatcatatactacgcagactctgtgaagggc

SEQ ID NO: 185 - DNA, 51 bp, Artificial Sequence
  17C8CDR2 (VH)
ttcattagtagtagtggtagtatcatatactacgcagactctgtgaagggc

SEQ ID NO: 186 - DNA, 39 bp, Artificial Sequence
  13A3, including the following 13A3 variants: N60Q, N60S, N60ACDR3 (VH)
ggggggccctacggtgactacgcccactggttcgacccc

SEQ ID NO: 187 - DNA, 27 bp, Artificial Sequence
  8B9, including the 8B9 (S61P) variantCDR3 (VH)
gatactgggtactacggtatggacatc

SEQ ID NO: 188 - DNA, 27 bp, Artificial Sequence
  8C4CDR3 (VH)
gatacgggctactacggtatggacgtc

SEQ ID NO: 189 - DNA, 42 bp, Artificial Sequence
  17C3CDR3 (VH)
gatttctatggttcgggaaactactactacggtatggacgtc

SEQ ID NO: 190 - DNA, 42 bp, Artificial Sequence
  9F6, including the 9F6 (A108T) variantCDR3 (VH)
gatggctatagcagtggctggtactactacggtatggacgtc

SEQ ID NO: 191 - DNA, 45 bp, Artificial Sequence
  3G4CDR3 (VH)
gaagggtatagcagcagctggtcctactactacggtatggacgtc

SEQ ID NO: 192 - DNA, 42 bp, Artificial Sequence
  17C8CDR3 (VH)
gatgggtatagcagtggctgggagtactacggtatggacgtc

SEQ ID NO: 193 - DNA, 324 bp, Artificial Sequence
  13A3, 17C3, 3G4, 23B3 (VK1), TIM3.25 VL
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaa

SEQ ID NO: 194 - DNA, 324 bp, Artificial Sequence
  8B9, 8C4, 17C8 , 9F6 (VK3) VL
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaa

SEQ ID NO: 195 - DNA, 321 bp, Artificial Sequence
  9F6 (VK1) VL
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcggacgttcggccaagggaccaaggtggaaatcaaa

SEQ ID NO: 196 - DNA, 321 bp, Artificial Sequence
  9F6 (VK2)VL
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactcactttcggcggagggaccaaggtggagatcaaa

SEQ ID NO: 197 - DNA, 36 bp, Artificial Sequence
  13A3, 8B9, 8C4, 17C3, 9F6 (VK2, VK3), 3G4, 17C8
  14H7, TIM3.24, 23B3 (VK1 and VK2), TIM3.25CDR1 (VL)
agggccagtcagagtgttagcagcagctacttagcc

SEQ ID NO: 198 - DNA, 33 bp, Artificial Sequence
  9F6 (VK1) CDR1 (VL)
cgggcaagtcagggcattagcagtgctttagcc

SEQ ID NO: 199 - DNA, 21 bp, Artificial Sequence
  13A3, 8B9, 8C4, 17C3, 9F6 (VK2, VK3), 3G4, 17C8
  14H7, TIM3.24, 23B3 (VK1 and VK2), TIM3.25CDR2 (VL)
ggtgcatccagcagggccact

SEQ ID NO: 200 - DNA, 21 bp, Artificial Sequence
  9F6 (VK1) CDR2 (VL)
gatgcctccagtttggaaagt

SEQ ID NO: 201 - DNA, 27 bp, Artificial Sequence
  13A3, 17C3, 3G4, 23B3 (VK1), TIM3.25 CDR3 (VL)
cagcagtatggtagctcaccgatcacc

SEQ ID NO: 202 - DNA, 27 bp, Artificial Sequence
  8B9, 8C4, 9F6 (VK3), 17C8, 14H7, TIM3.24CDR3 (VL)
cagcagtatggtagctcaccgctcact

SEQ ID NO: 203 - DNA, 27 bp, Artificial Sequence
  9F6 (VK1) CDR3 (VL)
caacagtttaatagttaccctcggacg

SEQ ID NO: 204 - DNA, 24 bp, Artificial Sequence
  CDR3 (VL)
cagcagtatggtagctcactcact

SEQ ID NO: 205 - DNA, 1362 bp, Artificial Sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 206 - DNA, 1362 bp, Artificial Sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactactcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 207 - DNA, 1362 bp, Artificial Sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacgcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 208 - DNA, 1362 bp, Artificial Sequence
  IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 209 - DNA, 1362 bp, Artificial Sequence
  13A3 (P102V) IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacgtatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 210 - DNA, 1362 bp, Artificial Sequence
  13A3 (P102Y)IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 211 - DNA, 1362 bp, Artificial Sequence
  13A3 (P102L)IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacctatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 212 - DNA, 1362 bp, Artificial Sequence
  13A3 (N60Q, P102Y)IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 213 - DNA, 1344 bp, Artificial Sequence
  8B9 (S61P)IgG1.1f HC
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaatccctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 214 - DNA, 1362 bp, Artificial Sequence
  9F6 (A108T)IgG1.1f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 215 - DNA, 1359 bp, Artificial Sequence
  13A3 (N60Q)IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 216 - DNA, 1359 bp, Artificial Sequence
  13A3 (N60S)IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactactcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 217 - DNA, 1359 bp, Artificial Sequence
  13A3 (N60A)IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacgcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 218 - DNA, 1359 bp, Artificial Sequence
  13A3 (D101E)IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 219 - DNA, 1359 bp, Artificial Sequence
  13A3 (P102V)IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacgtatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 220 - DNA, 1359 bp, Artificial Sequence
  13A3 (P102Y)IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 221 - DNA, 1359 bp, Artificial Sequence
  13A3 (P102L)IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacctatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 222 - DNA, 1359 bp, Artificial Sequence
  13A3 (N60Q, P102Y)IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 223 - DNA, 1341 bp, Artificial Sequence
  8B9 (S61P)IgG1.1f HC (no C-terminal K)
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaatccctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 224 - DNA, 1359 bp, Artificial Sequence
  9F6 (A108T)IgG1.1f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 225 - DNA, 1362 bp, Artificial Sequence
  13A3 (N60Q)IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 226 - DNA, 1362 bp, Artificial Sequence
  13A3 (N60S)IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactactcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 227 - DNA, 1362 bp, Artificial Sequence
  13A3 (N60A)IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacgcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 228 - DNA, 1362 bp, Artificial Sequence
  13A3 (D101E)IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 229 - DNA, 1362 bp, Artificial Sequence
  13A3 (P102V)IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacgtatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 230 - DNA, 1362 bp, Artificial Sequence
  13A3 (P102Y)IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 231 - DNA, 1362 bp, Artificial Sequence
  13A3 (P102L)IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacctatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 232 - DNA, 1362 bp, Artificial Sequence
  13A3 (N60Q, P102Y)IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 233 - DNA, 1344 bp, Artificial Sequence
  8B9 (S61P)IgG1.3f HC
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaatccctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 234 - DNA, 1362 bp, Artificial Sequence
  9F6 (A108T)IgG1.3f HC
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 235 - DNA, 1359 bp, Artificial Sequence
  13A3 (N60Q)IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 236 - DNA, 1359 bp, Artificial Sequence
  13A3 (N60S)IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactactcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 237 - DNA, 1359 bp, Artificial Sequence
  13A3 (N60A)IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacgcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 238 - DNA, 1359 bp, Artificial Sequence
  13A3 (D101E)IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 239 - DNA, 1359 bp, Artificial Sequence
  13A3 (P102V)IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacgtatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 240 - DNA, 1359 bp, Artificial Sequence
  13A3 (P102Y)IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 241 - DNA, 1359 bp, Artificial Sequence
  13A3 (P102L)IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacctatggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 242 - DNA, 1359 bp, Artificial Sequence
  13A3 (N60Q, P102Y)IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 243 - DNA, 1341 bp, Artificial Sequence
  8B9 (S61P)IgG1.3f HC (no C-terminal K)
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaatccctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 244 - DNA, 1359 bp, Artificial Sequence
  9F6 (A108T)IgG1.3f HC (no C-terminal K)
caggtgcagctggtggagtctgggggaggcttggtcaagcctggagggtccctgagactctcctgtgcagcctctggattcaccttcagtgactactacatgagctggatccgccaggctccagggaaggggctggagtgggtttcattcattagtggtggtggtagtaccatatactacgcagactctgtgaagggccgattcaccatctccagggacaacgccaagaactcgctgtttctgcaaatgaacagcctgagagtcgaggacacggctgtgtattactgtgcgagagatggctatagcagtggctggtactactacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 245 - DNA, 369 bp, Artificial Sequence
  13A3 (N60Q)VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctca

SEQ ID NO: 246 - DNA, 369 bp, Artificial Sequence
  13A3 (N60S)VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactactcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctca

SEQ ID NO: 247 - DNA, 369 bp, Artificial Sequence
  13A3 (N60A)VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacgcaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacccctggggccagggaaccctggtcaccgtctcctca

SEQ ID NO: 248 - DNA, 369 bp, Artificial Sequence
  13A3 (D101E)VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctca

SEQ ID NO: 249 - DNA, 369 bp, Artificial Sequence
  13A3 (P102V)VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacgtatggggccagggaaccctggtcaccgtctcctca

SEQ ID NO: 250 - DNA, 369 bp, Artificial Sequence
  13A3 (P102Y)VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctca

SEQ ID NO: 251 - DNA, 369 bp, Artificial Sequence
  25113A3 (P102L)VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactacaacccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgacctatggggccagggaaccctggtcaccgtctcctca

SEQ ID NO: 252 - DNA, 369 bp, Artificial Sequence
  13A3 (N60Q, P102Y)VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgactactggggccagggaaccctggtcaccgtctcctca

SEQ ID NO: 253 - DNA, 351 bp, Artificial Sequence
  8B9 (S61P)VH
caggtgcagctgcaggagtcgggcccaggactggtgaagccttcggagaccctgtccctcacctgcactgtctctggtggctccatcagtcgtcactactggaactggatccggcagcccccagggaagggactggagtggattgggtatatccattacagtggaagcaccaactacaatccctccctcaagagtcgagtcaccatatcagtagacacgtccaagaaccagttctccctgaagctgagctctgtgaccgctgcggacacggccgtgtattactgtgcgagagatactgggtactacggtatggacatctggggccaagggaccacggtcaccgtctcctca

SEQ ID NO: 254 - DNA, 369 bp, Artificial Sequence; identical to SEQ ID NO: 246
  9F6 (A108T)VH

SEQ ID NO: 255 - DNA, 48 bp, Artificial Sequence
  13A3 (N60Q); 13A3 (N60Q, P102Y); 13A3 (N60Q, D101E)CDR2 (VH)
agtatctattatagtgggttcacctactaccaaccgtccctcaagagt

SEQ ID NO: 256 - DNA, 48 bp, Artificial Sequence
  13A3 (N60S)CDR2 (VH)
agtatctattatagtgggttcacctactactcaccgtccctcaagagt

SEQ ID NO: 257 - DNA, 48 bp, Artificial Sequence
  13A3 (N60A)CDR2 (VH)
agtatctattatagtgggttcacctactacgcaccgtccctcaagagt

SEQ ID NO: 258 - DNA, 48 bp, Artificial Sequence
  8B9 (S61P)CDR2 (VH)
tatatccattacagtggaagcaccaactacaatccctccctcaagagt

SEQ ID NO: 259 - DNA, 39 bp, Artificial Sequence
  13A3 (D101E)CDR3 (VH)
ggggggccctacggtgactacgcccactggttcgaaccc

SEQ ID NO: 260 - DNA, 39 bp, Artificial Sequence
  13A3 (P102V)CDR3 (VH)
ggggggccctacggtgactacgcccactggttcgacgta

SEQ ID NO: 261 - DNA, 39 bp, Artificial Sequence
  13A3 (P102Y); 13A3 (N60Q, P102Y); 13A3 (N60Q, D101E)CDR3 (VH)
ggggggccctacggtgactacgcccactggttcgactac

SEQ ID NO: 262 - DNA, 39 bp, Artificial Sequence
  13A3 (P102L)CDR3 (VH)
ggggggccctacggtgactacgcccactggttcgaccta

SEQ ID NO: 263 - DNA, 994 bp, Artificial Sequence
  All antibodiesHC Constant Domain (IgG1.1f)
agctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 264 - DNA, 991 bp, Artificial Sequence
  All antibodiesHC Constant Domain (IgG1.1f) (no C-terminal K)
agctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 265 - DNA, 994 bp, Artificial Sequence
  All antibodiesHC Constant Domain (IgG1.3f)
agctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 266 - DNA, 991 bp, Artificial Sequence
  All antibodiesHC Constant Domain (IgG1.3f) (no C-terminal K)
agctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 267 - protein, 19 aa, Artificial Sequence
  Signal Peptide
MDWTWRVFCLLAVAPGAHS

SEQ ID NO: 268 - protein, 20 aa, Artificial Sequence
  Signal Peptide
METPAQLLFLLLLWLPDTTG

SEQ ID NO: 269 - protein, 19 aa, Artificial Sequence
  Signal Peptide
MKHLWFFLLLVAAPRWVLS

SEQ ID NO: 270 - protein, 19 aa, Artificial Sequence
  Signal Peptide
MEFGLSWVFLVAIIKGVQC

SEQ ID NO: 271 - protein, 21 aa, Artificial Sequence
  Signal Peptide
MDMRVPAQLLGLLLWLPGARC

SEQ ID NO: 272 - DNA, 43 bp, Artificial Sequence
  Signal Peptide
atggactggacctggagggtcttctgcttgctggctgtagctc

SEQ ID NO: 273 - DNA, 60 bp, Artificial Sequence
  Signal Peptide
atggaaaccccagcgcagcttctcttcctcctgctactctggctcccagataccaccgga

SEQ ID NO: 274 - DNA, 57 bp, Artificial Sequence
  Signal Peptide
atgaagcacctgtggttcttcctcctgctggtggcggctcccagatgggtcctgtcc

SEQ ID NO: 275 - DNA, 51 bp, Artificial Sequence
  Signal Peptide
atggagtttgggctgagctgggttttccttgttgctattataaaaggtgtc

SEQ ID NO: 276 - DNA, 66 bp, Artificial Sequence
  Signal Peptide
atggacatgagggtccccgctcagctcctggggcttctgctgctctggctcccaggtgccagatgt

SEQ ID NO: 277 - protein, 330 aa, Artificial Sequence
  human IgG1 (allotypic variant)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - protein, 107 aa, Artificial Sequence [sequence omitted]

SEQ ID NO: 279 - protein, 5 aa, Artificial Sequence
  LSPGK (C-terminal end of heavy chain)
LSPGK

SEQ ID NO: 280 - protein, 4 aa, Artificial Sequence
  LSPG (C-terminal end of heavy chain)
LSPG

SEQ ID NO: 281 - protein, 3 aa, Artificial Sequence
  LSP (C-terminal end of heavy chain)
LSP

SEQ ID NO: 282 - protein, 7 aa, Artificial Sequence
  X1X2X3X4YX5X6 (VH CDR1 degenerate)
  misc_feature (1)..(4): Xaa can be any naturally occurring amino acid
  misc_feature (6)..(7): Xaa can be any naturally occurring amino acid
XXXXYXX

SEQ ID NO: 283 - protein, 17 aa, Artificial Sequence
  X1IX2X3X4GX5X6X7X8YX9X10X11X12X13X14 (VH CDR2 degenerate)
  misc_feature (1)..(1): Xaa can be any naturally occurring amino acid
  misc_feature (3)..(5): Xaa can be any naturally occurring amino acid
  misc_feature (7)..(10): Xaa can be any naturally occurring amino acid
  misc_feature (12)..(17): Xaa can be any naturally occurring amino acid
XIXXXGXXXXYXXXXXX

SEQ ID NO: 284 - protein, 20 aa, Artificial Sequence
  X1X2X3X4X5X6X7X8X9X10X11X12X13X14X15X16X17X18X19X20 (VH CDR3 degenerate)
  misc_feature (1)..(20): Xaa can be any naturally occurring amino acid
XXXXXXXXXXXXXXXXXXXX

SEQ ID NO: 285 - protein, 9 aa, Artificial Sequence
  QQX1X2SX3X4X5T (VL CDR1 degenerate)
  misc_feature (3)..(4): Xaa can be any naturally occurring amino acid
  misc_feature (6)..(9): Xaa can be any naturally occurring amino acid
QQXXSXXXX

SEQ ID NO: 286 - protein, 300 aa, Artificial Sequence
  TIM3 Isoform 1 (aa)
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAM

SEQ ID NO: 287 - protein, 142 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPGEWTFACHLYE

SEQ ID NO: 288 - DNA, 2448 bp, Homo sapiens
agaacacttacaggatgtgtgtagtgtggcatgacagagaactttggtttcctttaatgtgactgtagacctggcagtgttactataagaatcactggcaatcagacacccgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgttaaaaaaaaaaaaaaaaaa

SEQ ID NO: 289 - DNA, 1012 bp, Homo sapiens
actgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccaggtgagtggacatttgcatgccatctttatgaataagatttatctgtggatcatattaaaggtactgattgttctcatctctgacttccctaattatagccctggaggagggccactaagacctaaagtttaacaggccccattggtgatgctcagtgatatttaacaccttctctctgttttaaaactcatgggtgtgcctgggcgtggtggctcgcgcctctggtcccagcactttgggaggctgaggccggtggatcatgaggtcaggaattcgagaccagcctggccaacatggtaaaaccttgtctccactaaaaatacaaaaaattagccaggcatggttacgggagcctgtaattctagctacttggggggctgaagcaggagaatcacttgaacctggaagtcggaggttgcggtaagccaagatctcgccattgtactccagcctggctgacaagagtgaaactctgtcccaaaaaaaaaaaaaaaaaaaaaaaaaaaaaa

SEQ ID NO: 290 - protein, 181 aa, Homo sapiens
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 291 - protein, 330 aa, Homo sapiens [sequence omitted]

SEQ ID NO: 292 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 293 - protein, 107 aa, Homo sapiens [sequence omitted]

SEQ ID NO: 294 - protein, 330 aa, Homo sapiens; identical to SEQ ID NO: 130

SEQ ID NO: 295 - protein, 330 aa, Homo sapiens; identical to SEQ ID NO: 132

SEQ ID NO: 296 - protein, 7 aa, Homo sapiens
CPVFECG

SEQ ID NO: 297 - protein, 12 aa, Homo sapiens
WTSRYWLNGDFR

SEQ ID NO: 298 - protein, 10 aa, Homo sapiens
RIQIPGIMND

SEQ ID NO: 299 - protein, 99 aa, Homo sapiens
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMND

SEQ ID NO: 300 - protein, 5 aa, Artificial Sequence
  Linker
PVGVV

SEQ ID NO: 301 - protein, 450 aa, Artificial Sequence
  13A3hIgG4 HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 302 - protein, 449 aa, Artificial Sequence
  13A3hIgG4 HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 303 - protein, 450 aa, Artificial Sequence
  TIM3 13A3IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 304 - protein, 449 aa, Artificial Sequence
  TIM3.5  13A3IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 305 - protein, 450 aa, Artificial Sequence
  TIM3.10  13A3 (N60Q)IgG4P HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 306 - protein, 449 aa, Artificial Sequence
  TIM3.10  13A3 (N60Q)IgG4P HC (without C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 307 - protein, 450 aa, Artificial Sequence
  TIM3.11  13A3 (N60S)IgG4P HC
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 308 - protein, 449 aa, Artificial Sequence
  TIM3.11 13A3 (N60S)IgG4P HC (without C-terminal K)
QLQLQESGPGLVKPSETLSLTCTVSGGSISSRSYYWGWIRQPPGKGLEWIGSIYYSGFTYYSPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 309 - protein, 450 aa, Artificial Sequence
  TIM3.12  13A3 (N60A)IgG4P HC
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 310 - protein, 449 aa, Artificial Sequence
  TIM3.12  13A3 (N60A)IgG4P HC (without C-terminal K)
QLQLQESGPGLVKPSETLSLTCTVSGGSISSRSYYWGWIRQPPGKGLEWIGSIYYSGFTYYAPSLKSRVTISVDTSKNQFSLKLSSVTAADTAVYYCATGGPYGDYAHWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 311 - protein, 450 aa, Artificial Sequence
  TIM3.13  13A3 (D101E)IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 312 - protein, 449 aa, Artificial Sequence
  TIM3.13  13A3 (D101E)IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFEPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 313 - protein, 450 aa, Artificial Sequence
  TIM 3.14 13A3 (P102V)IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 314 - protein, 449 aa, Artificial Sequence
  TIM 3.14  13A3 (P102V)IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDVWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 315 - protein, 450 aa, Artificial Sequence
  TIM3.15  13A3 (P102Y)IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 316 - protein, 449 aa, Artificial Sequence
  TIM3.15  13A3 (P102Y)IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 317 - protein, 450 aa, Artificial Sequence
  TIM3.16  13A3 (P102L)IgG4P HC
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 318 - protein, 449 aa, Artificial Sequence
  TIM3.16  13A3 (P102L)IgG4P HC (without C-terminal K)
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDLWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 319 - protein, 450 aa, Artificial Sequence
  TIM3.17  13A3 (N60Q, P102Y)IgG4P HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 320 - protein, 449 aa, Artificial Sequence
  TIM3.17 13A3 (N60Q, P102Y)IgG4P HC (without C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 321 - protein, 447 aa, Artificial Sequence
  8B9IgG1za HC
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 322 - protein, 446 aa, Artificial Sequence
  8B9IgG1za HC (without C-terminal K)
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 323 - protein, 444 aa, Artificial Sequence
  8B9IgG4P HC
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 324 - protein, 443 aa, Artificial Sequence
  8B9IgG4P HC (without C-terminal K)
QVQLQESGPGLVKPSETLSLTCTVSGGSISRHYWNWIRQPPGKGLEWIGYIHYSGSTNYNSSLKSRVTISVDTSKNQFSLKLSSVTAADTAVYYCARDTGYYGMDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 325 - protein, 444 aa, Artificial Sequence
  TIM3.8 8B9 (S61P)IgG4P HC
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 326 - protein, 443 aa, Artificial Sequence
  TIM3.8 8B9 (S61P)IgG4P HC (without C-terminal K)
QVQLQESGPGLVKPSETLSLTCTVSGGSISRHYWNWIRQPPGKGLEWIGYIHYSGSTNYNPSLKSRVTISVDTSKNQFSLKLSSVTAADTAVYYCARDTGYYGMDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 327 - protein, 447 aa, Artificial Sequence
  8C4IgG1za HC
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 328 - protein, 446 aa, Artificial Sequence
  8C4IgG1za HC (without C-terminal K)
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 329 - protein, 367 aa, Artificial Sequence
  TIM3.6 8C4IgG4P HC
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 330 - protein, 366 aa, Artificial Sequence
  TIM3.6 8C4IgG4P HC (without C-terminal K)
QVQLQESGPGLVKPSETLSLTCTVSGGSISRYYWSWIRQPPGKGLEWIGYIHYTGSTNYNPSLKSRVTISVDTSKNQFSLKLSSVTAADTAVYYCATDTGYYGMDVWGQGTTVTVSSTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 331 - protein, 453 aa, Artificial Sequence
  17C3IgG1za HC
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 332 - protein, 452 aa, Artificial Sequence
  17C3IgG1za HC (without C-terminal K)
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 333 - protein, 450 aa, Artificial Sequence
  TIM3.2 17C3IgG4P HC
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 334 - protein, 449 aa, Artificial Sequence
  TIM3.2 17C3IgG4P HC (without C-terminal K)
QVQLVQSGAEVKKPGASVKVSCKASGYTFTSYYMHWVRQAPGQGLEWMGIINPRGDSIIYAQKFQGRVTMTRDTSTSTVYMELSSLRSEDTAVYYCARDFYGSGNYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 335 - protein, 453 aa, Artificial Sequence
  9F6IgG1za HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 336 - protein, 452 aa, Artificial Sequence
  9F6IgG1za HC (without C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 337 - protein, 450 aa, Artificial Sequence
  9F6IgG4P HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 338 - protein, 449 aa, Artificial Sequence
  9F6IgG4P HC (without C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTAVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 339 - protein, 450 aa, Artificial Sequence
  TIM3.7 9F6 (A108T)IgG4P HC
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 340 - protein, 449 aa, Artificial Sequence
  TIM3.7 9F6 (A108T)IgG4P HC (without C-terminal K)
QVQLVESGGGLVKPGGSLRLSCAASGFTFSDYYMSWIRQAPGKGLEWVSFISGGGSTIYYADSVKGRFTISRDNAKNSLFLQMNSLRVEDTAVYYCARDGYSSGWYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 341 - protein, 454 aa, Artificial Sequence
  3G4IgG1za HC
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 342 - protein, 453 aa, Artificial Sequence
  3G4IgG1za HC (without C-terminal K)
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 343 - protein, 451 aa, Artificial Sequence
  TIM3.4 3G4IgG4P HC
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 344 - protein, 450 aa, Artificial Sequence
  TIM3.4 3G4IgG4P HC (without C-terminal K)
QVQLVESGGGLVKPGGSLRLSCAASGFTFSDYYMSWIRQAPGKGLEWVSFISTSGSIIYYADSVKGRFTISRDNAKNSLYLQMNSLRAEDTAVYYCAREGYSSSWSYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 345 - protein, 450 aa, Artificial Sequence
  17C8IgG4 HC
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 346 - protein, 449 aa, Artificial Sequence
  17C8IgG4 HC (without C-terminal K)
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 347 - protein, 450 aa, Artificial Sequence
  TIM3.9 17C8IgG4P HC
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 348 - protein, 449 aa, Artificial Sequence
  TIM3.9 17C8IgG4P HC (without C-terminal K)
QVQLVESGGGLVKPGGSLRLSCAASGFTFSDYYMSWIRQAPGKGLEWVSFISSSGSIIYYADSVKGRFTISRDNAKNSLYLQMNSLRAEDTAVYYCARDGYSSGWEYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 349 - protein, 453 aa, Artificial Sequence
  13A3 (N60Q, D101E)IgG1.1f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 350 - protein, 452 aa, Artificial Sequence
  13A3 (N60Q, D101E)IgG1.1f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 351 - protein, 453 aa, Artificial Sequence
  13A3 (N60Q, D101E)IgG1.3f HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 352 - protein, 452 aa, Artificial Sequence
  13A3 (N60Q, D101E)IgG1.3f HC (no C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 353 - protein, 450 aa, Artificial Sequence
  TIM3.18 13A3 (N60Q, D101E)IgG4P HC
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 354 - protein, 449 aa, Artificial Sequence
  TIM3.18 13A3 (N60Q, D101E)IgG4P HC (without C-terminal K)
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 355 - DNA, 1362 bp, Artificial Sequence
  13A3 (N60Q, D101E)IgG1.1f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 356 - DNA, 1359 bp, Artificial Sequence
  13A3 (N60Q, D101E)IgG1.1f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 357 - DNA, 1362 bp, Artificial Sequence
  13A3 (N60Q, D101E)IgG1.3f HC
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 358 - DNA, 1359 bp, Artificial Sequence
  13A3 (N60Q, D101E)IgG1.3f HC (no C-terminal K)
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 359 - DNA, 369 bp, Artificial Sequence
  13A3 (N60Q, D101E)VH
cagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctca

SEQ ID NO: 360 - protein, 294 aa, Artificial Sequence
  Signal Peptide (TIM3.2-TIM3.18)
MFSHLPFDCVLLLLLLLLTRSSEVEYIAEVGQNAYLPCSYTPAPPGNLVPVCWGKGACPVFDCSNVVLRTENRDVNDRTSGRYWLKGDFHKGDVSLTIENVTLADSGVYCCRIQIPGIMNDEKHNLKLVVIKPAKVTPAPTLQRDLTSAFPRMLTTGEHGPAETQTPGSLPDVNLTQIFTLTNELRDSGATIRTAIYIAAGISAGLALALIFGALIFKWYSHSKEKTQNLSLISLANIPPSGLANAVAEGIRSEENIYTIEEDVYEVEEPNEYYCYVSSGQQPSQPLGCRFAMP

SEQ ID NO: 361 - protein, 17 aa, Artificial Sequence
  Signal Peptide (TIM3.2-TIM3.18)
MRAWIFFLLCLAGRALA

SEQ ID NO: 362 - DNA, 51 bp, Homo sapiens
atgagggcttggatcttctttctgctctgcctggccgggagagcgctcgca

SEQ ID NO: 363 - DNA, 51 bp, Artificial Sequence
  Signal Peptide (TIM3.2-TIM3.18 LC)
atgagggcttggatcttctttctgctctgcctggccgggcgcgccttggcc

SEQ ID NO: 364 - protein, 123 aa, Artificial Sequence
  13A3 (N60Q, D101E)VH
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSS

SEQ ID NO: 365 - protein, 234 aa, Artificial Sequence
  13A3HC Fab
QLQLQESGPGLVKPSETLSLTCTVSGGSISSRSYYWGWIRQPPGKGLEWIGSIYYSGFTYYNPSLKSRVTISVDTSKNQFSLKLSSVTAADTAVYYCATGGPYGDYAHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGHHHHHH

SEQ ID NO: 366 - protein, 234 aa, Artificial Sequence
  TIM3.18  13A3 (N60Q, D101E)HCFab
QLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGHHHHHH

SEQ ID NO: 367 - protein, 14 aa, Homo sapiens
VPVCWGKGACPVFE

SEQ ID NO: 368 - protein, 17 aa, Homo sapiens
RIQIPGIMNDEKFNLKL

SEQ ID NO: 369 - protein, 23 aa, Homo sapiens
YTPAAPGNLVPVCWGKGACPVFE

SEQ ID NO: 370 - protein, 12 aa, Homo sapiens
VVLRTDERDVNY

SEQ ID NO: 371 - protein, 18 aa, Homo sapiens
WTSRYWLNGDFRKGDVSL

SEQ ID NO: 372 - protein, 18 aa, Homo sapiens
CRIQIPGIMNDEKFNLKL

SEQ ID NO: 373 - protein, 9 aa, Homo sapiens
NDEKFNLKL

SEQ ID NO: 374 - DNA, 1359 bp, Homo sapiens
cagctgcagctgcaggagtcgggcccaggactggtgaagccttcggagaccctgtccctcacctgcactgtctctggtggctccatcagcagtagaagttactactggggctggattcgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 375 - protein, 410 aa, Artificial Sequence
  hTIM3-mFc
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGASVPRDCGCKPCICTVPEVSSVFIFPPKPKDVLTITLTPKVTCVVVAISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 376 - protein, 154 aa, Artificial Sequence
  cynoTIM3-MycHisAvi
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKSPGGGSGGGSEQKLISEEDLGHHHHHHGLNDIFEAQKIEWHE

SEQ ID NO: 377 - protein, 129 aa, Artificial Sequence
  hTIM3_IgV
HHHHHHSAALEVLFQGPGSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPA

SEQ ID NO: 378 - protein, 470 aa, Artificial Sequence
  13A3 (N60Q, D101E) (TIM3.18)IgG1.3f HC with signal peptide
MRAWIFFLLCLAGRALAQLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 379 - protein, 469 aa, Artificial Sequence
  13A3 (N60Q, D101E) (TIM3.18)IgG1.3f HC (no C-terminal K) with signal peptide
MRAWIFFLLCLAGRALAQLQLQESGPGLVKPSETLSLTCTVSGGSISSRSYYWGWIRQPPGKGLEWIGSIYYSGFTYYQPSLKSRVTISVDTSKNQFSLKLSSVTAADTAVYYCATGGPYGDYAHWFEPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 380 - DNA, 1413 bp, Artificial Sequence
  13A3 (N60Q, D101E) (TIM3.18)IgG1.3f HC with signal peptide
atgagggcttggatcttctttctgctctgcctggccgggagagcgctcgcacagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 381 - DNA, 1410 bp, Artificial Sequence
  13A3 (N60Q, D101E) (TIM3.18)IgG1.3f HC (no C-terminal K) with signal peptide
atgagggcttggatcttctttctgctctgcctggccgggagagcgctcgcacagctgcagctgcaggagtcgggcccaggactggtgaagccttcggagaccctgtccctcacctgcactgtctctggtggctccatcagcagtagaagttactactggggctggatccgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 382 - DNA, 1413 bp, Artificial Sequence
  13A3 (N60Q, D101E) (TIM3.18)IgG1.3f HC (T168C) with signal sequence
atgagggcttggatcttctttctgctctgcctggccgggagagcgctcgcacagctgcagctgcaggagtcgggcccaggactggtgaagccttcggagaccctgtccctcacctgcactgtctctggtggctccatcagcagtagaagttactactggggctggattcgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 383 - DNA, 1410 bp, Artificial Sequence
  13A3 (N60Q, D101E) (TIM3.18)IgG1.3f HC (T168C) (no C-terminal K) with signal sequence
atgagggcttggatcttctttctgctctgcctggccgggagagcgctcgcacagctgcagctgcaggagtcgggcccaggactggtgaagccttcggagaccctgtccctcacctgcactgtctctggtggctccatcagcagtagaagttactactggggctggattcgccagcccccagggaaggggctggagtggattgggagtatctattatagtgggttcacctactaccaaccgtccctcaagagtcgagtcaccatatccgttgacacgtccaagaaccagttctccctgaagctgagctctgtgaccgccgcagacacggctgtgtattattgtgcgacaggggggccctacggtgactacgcccactggttcgaaccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 384 - protein, 232 aa, Artificial Sequence
  13A3 (N60Q, D101E) (TIM3.18)LC with signal sequence
MRAWIFFLLCLAGRALAEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 385 - DNA, 699 bp, Artificial Sequence
  13A3 (N60Q, D101E) (TIM3.18)LC with signal sequence
atgagggcttggatcttctttctgctctgcctggccgggcgcgccttggccgaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 386 - protein, 440 aa, Artificial Sequence
  14H7hIgG4 HC
QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 387 - protein, 439 aa, Artificial Sequence
  14H7hIgG4 HC (without C-terminal K)
QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 388 - protein, 443 aa, Artificial Sequence
  TIM3.24 14H7IgG1.1f HC
QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 389 - protein, 442 aa, Artificial Sequence
  TIM3.24 14H7IgG1.1 HC (without C-terminal K)
QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 390 - protein, 443 aa, Artificial Sequence
  TIM3.24 14H7IgG1.3f HC
QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - protein, 442 aa, Artificial Sequence
  TIM3.24 14H7IgG1.3f HC (without C-terminal K)
QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 392 - protein, 440 aa, Artificial Sequence
  TIM3.24 14H7IgG4P HC
QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 393 - protein, 439 aa, Artificial Sequence
  TIM3.24 14H7IgG4P HC (without C-terminal K)
QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 394 - protein, 450 aa, Artificial Sequence
  23B3hIgG4 HC
QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 395 - protein, 449 aa, Artificial Sequence
  23B3hIgG4 HC (without C-terminal K)
QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 396 - protein, 453 aa, Artificial Sequence
  23B3IgG1.1f HC
QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 397 - protein, 452 aa, Artificial Sequence
  23B3IgG1.1 HC (without C-terminal K)
QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 398 - protein, 453 aa, Artificial Sequence
  23B3IgG1.3f HC
QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 399 - protein, 452 aa, Artificial Sequence
  23B3IgG1.3f HC (without C-terminal K)
QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 400 - protein, 450 aa, Artificial Sequence
  23B3IgG4P HC
QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 401 - protein, 449 aa, Artificial Sequence
  23B3IgG4P HC (without C-terminal K)
QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 402 - protein, 453 aa, Artificial Sequence
  TIM3.25 (23B3-VH-G6E-D79Y)IgG1.1f HC
QVQLVESGGGLVKPGGSLRLSCAASGFTFSDYYMSWIRQAPGKGLEWVSFISGSGSIIYYADSVKGRFTISRDNAKNSLYLQMNSLRAEDTAVYYCARDGMVRGMNFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - protein, 452 aa, Artificial Sequence
  TIM3.25 (23B3-VH-G6E-D79Y)IgG1.1 HC (without C-terminal K)
QVQLVESGGGLVKPGGSLRLSCAASGFTFSDYYMSWIRQAPGKGLEWVSFISGSGSIIYYADSVKGRFTISRDNAKNSLYLQMNSLRAEDTAVYYCARDGMVRGMNFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 404 - protein, 453 aa, Artificial Sequence
  TIM3.25 (23B3-VH-G6E-D79Y)IgG1.3f HC
QVQLVESGGGLVKPGGSLRLSCAASGFTFSDYYMSWIRQAPGKGLEWVSFISGSGSIIYYADSVKGRFTISRDNAKNSLYLQMNSLRAEDTAVYYCARDGMVRGMNFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 452 aa, Artificial Sequence
  TIM3.25 (23B3-VH-G6E-D79Y)IgG1.3f HC (without C-terminal K)
QVQLVESGGGLVKPGGSLRLSCAASGFTFSDYYMSWIRQAPGKGLEWVSFISGSGSIIYYADSVKGRFTISRDNAKNSLYLQMNSLRAEDTAVYYCARDGMVRGMNFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 406 - protein, 450 aa, Artificial Sequence
  TIM3.25 (23B3-VH-G6E-D79Y)IgG4P HC
QVQLVESGGGLVKPGGSLRLSCAASGFTFSDYYMSWIRQAPGKGLEWVSFISGSGSIIYYADSVKGRFTISRDNAKNSLYLQMNSLRAEDTAVYYCARDGMVRGMNFYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 407 - protein, 449 aa, Artificial Sequence
  TIM3.25  (23B3-VH-G6E-D79Y)IgG4P HC (without C-terminal K)
QVQLVESGGGLVKPGGSLRLSCAASGFTFSDYYMSWIRQAPGKGLEWVSFISGSGSIIYYADSVKGRFTISRDNAKNSLYLQMNSLRAEDTAVYYCARDGMVRGMNFYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 408 - protein, 215 aa, Artificial Sequence
  14H7 (TIM3.24)LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 409 - protein, 213 aa, Artificial Sequence
  23B3LC (VK2)
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 410 - protein, 113 aa, Artificial Sequence
  14H7/TIM3.24VH
QVHLVESGGGLVKPGGSLRLSCTAFSDYYMSWIRQAPGKGLEWLSYISNSGSIIYYADSVKGRFTISRDNAKNSVYLQMNSLRAEDTAVYYCARGRIGFFDYWGPGTLVTVSS

SEQ ID NO: 411 - protein, 123 aa, Artificial Sequence
  23B3VH
QVQLVGSGGGLVKPGGSLRLSCAASGFTFSDYYMSWIRQAPGKGLEWVSFISGSGSIIYYADSVKGRFTISRDNAKNSLDLQMNSLRAEDTAVYYCARDGMVRGMNFYGMDVWGQGTTVTVSS

SEQ ID NO: 412 - protein, 123 aa, Artificial Sequence
  TIM3.25 (23B3-VH-G6E-D79Y)VH
QVQLVESGGGLVKPGGSLRLSCAASGFTFSDYYMSWIRQAPGKGLEWVSFISGSGSIIYYADSVKGRFTISRDNAKNSLYLQMNSLRAEDTAVYYCARDGMVRGMNFYGMDVWGQGTTVTVSS

SEQ ID NO: 413 - protein, 17 aa, Artificial Sequence
  14H7/TIM3.24CDR2 (VH)
YISNSGSIIYYADSVKG

SEQ ID NO: 414 - protein, 8 aa, Artificial Sequence
  14H7/TIM3.24CDR3 (VH)
GRIGFFDY

SEQ ID NO: 415 - protein, 17 aa, Artificial Sequence
  23B3/TIM3.25CDR2 (VH)
FISGSGSIIYYADSVKG

SEQ ID NO: 416 - protein, 14 aa, Artificial Sequence
  23B3/TIM3.25CDR3 (VH)
DGMVRGMNFYGMDV

SEQ ID NO: 417 - protein, 108 aa, Artificial Sequence
  14H7VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGPGTKVDIK

SEQ ID NO: 418 - protein, 106 aa, Artificial Sequence
  23B3VL (VK2)
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFGGGTKVEIK

SEQ ID NO: 419 - protein, 7 aa, Artificial Sequence
  23B3CDR3 (VL) (VK2)
QQYGSSP

SEQ ID NO: 420 - DNA, 339 bp, Artificial Sequence
  14H7/TIM3.24VH
caggtgcacctggtggagtctgggggaggcttggtcaagcctggagggtccctgagactctcctgtacagccttcagtgactactacatgagctggatccgccaggctccagggaaggggctggagtggttatcatacattagtaatagtggtagtatcatatactacgcagactctgtgaagggccgattcaccatctccagggacaacgccaagaactcagtgtatctgcaaatgaacagcctgagagccgaggacacggctgtgtattactgtgcgagagggcgaattggtttttttgactactggggcccgggaaccctggtcaccgtctcctca

SEQ ID NO: 421 - DNA, 369 bp, Artificial Sequence
  23B3VH
caggtgcagctggtgggatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactggatctgcaaatgaacagcctgagagccgaggacacggctgtgtattactgtgcgagagacggtatggttcggggaatgaacttctacggtatggacgtctggggccaagggaccacggtcaccgtctcctca

SEQ ID NO: 422 - DNA, 369 bp, Artificial Sequence
  TIM3.25  (23B3-VH-G6E-D79Y)VH
caggtgcagctggtggaatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactgtatctgcaaatgaacagcctgagagccgaggacacggctgtgtattactgtgcgagagacggtatggttcggggaatgaacttctacggtatggacgtctggggccaagggaccacggtcaccgtctcctca

SEQ ID NO: 423 - DNA, 51 bp, Artificial Sequence
  14H7/TIM3.24CDR2 (VH)
tacattagtaatagtggtagtatcatatactacgcagactctgtgaagggc

SEQ ID NO: 424 - DNA, 24 bp, Artificial Sequence
  14H7/TIM3.24CDR3 (VH)
gggcgaattggtttttttgactac

SEQ ID NO: 425 - DNA, 51 bp, Artificial Sequence
  23B3/TIM3.25CDR2 (VH)
ttcattagtggtagtggtagtatcatatactacgcagactctgtgaagggc

SEQ ID NO: 426 - DNA, 42 bp, Artificial Sequence
  23B3/TIM3.25CDR3 (VH)
gacggtatggttcggggaatgaacttctacggtatggacgtc

SEQ ID NO: 427 - DNA, 324 bp, Artificial Sequence
  14H7VL
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctcactttcggccctgggaccaaagtggatatcaaa

SEQ ID NO: 428 - DNA, 318 bp, Artificial Sequence
  23B3VL (VK2)
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctttcggcggagggaccaaggtggagatcaaa

SEQ ID NO: 429 - DNA, 21 bp, Artificial Sequence
  23B3CDR3 (VL) (VK2)
cagcagtatggtagctcacct

SEQ ID NO: 430 - DNA, 1332 bp, Artificial Sequence
  TIM3.24 14H7hIgG4
caggtgcacctggtggagtctgggggaggcttggtcaagcctggagggtccctgagactctcctgtacagccttcagtgactactacatgagctggatccgccaggctccagggaaggggctggagtggttatcatacattagtaatagtggtagtatcatatactacgcagactctgtgaagggccgattcaccatctccagggacaacgccaagaactcagtgtatctgcaaatgaacagcctgagagccgaggacacggctgtgtattactgtgcgagagggcgaattggtttttttgactactggggcccgggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 431 - DNA, 1329 bp, Artificial Sequence
  TIM3.24 14H7IgG1.1 HC (without C-terminal K)
caggtgcacctggtggagtctgggggaggcttggtcaagcctggagggtccctgagactctcctgtacagccttcagtgactactacatgagctggatccgccaggctccagggaaggggctggagtggttatcatacattagtaatagtggtagtatcatatactacgcagactctgtgaagggccgattcaccatctccagggacaacgccaagaactcagtgtatctgcaaatgaacagcctgagagccgaggacacggctgtgtattactgtgcgagagggcgaattggtttttttgactactggggcccgggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 432 - DNA, 1332 bp, Artificial Sequence
  TIM3.24 14H7IgG1.3f HC
caggtgcacctggtggagtctgggggaggcttggtcaagcctggagggtccctgagactctcctgtacagccttcagtgactactacatgagctggatccgccaggctccagggaaggggctggagtggttatcatacattagtaatagtggtagtatcatatactacgcagactctgtgaagggccgattcaccatctccagggacaacgccaagaactcagtgtatctgcaaatgaacagcctgagagccgaggacacggctgtgtattactgtgcgagagggcgaattggtttttttgactactggggcccgggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 433 - DNA, 1329 bp, Artificial Sequence
  TIM3.24 14H7IgG1.3f HC (without C-terminal K)
caggtgcacctggtggagtctgggggaggcttggtcaagcctggagggtccctgagactctcctgtacagccttcagtgactactacatgagctggatccgccaggctccagggaaggggctggagtggttatcatacattagtaatagtggtagtatcatatactacgcagactctgtgaagggccgattcaccatctccagggacaacgccaagaactcagtgtatctgcaaatgaacagcctgagagccgaggacacggctgtgtattactgtgcgagagggcgaattggtttttttgactactggggcccgggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 434 - DNA, 1362 bp, Artificial Sequence
  23B3IgG1.1f HC
caggtgcagctggtgggatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactggatctgcaaatgaacagcctgagagccgaggacacggctgtgtattactgtgcgagagacggtatggttcggggaatgaacttctacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 435 - DNA, 1359 bp, Artificial Sequence
  23B3IgG1.1 HC (without C-terminal K)
caggtgcagctggtgggatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactggatctgcaaatgaacagcctgagagccgaggacacggctgtgtattactgtgcgagagacggtatggttcggggaatgaacttctacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 436 - DNA, 1362 bp, Artificial Sequence
  23B3IgG1.3f HC
caggtgcagctggtgggatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactggatctgcaaatgaacagcctgagagccgaggacacggctgtgtattactgtgcgagagacggtatggttcggggaatgaacttctacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 437 - DNA, 1359 bp, Artificial Sequence
  23B3IgG1.3f HC (without C-terminal K)
caggtgcagctggtgggatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactggatctgcaaatgaacagcctgagagccgaggacacggctgtgtattactgtgcgagagacggtatggttcggggaatgaacttctacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 438 - DNA, 1362 bp, Artificial Sequence
  TIM3.25 (23B3-VH-G6E-D79Y)IgG1.1f HC
caggtgcagctggtggaatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactgtatctgcaaatgaacagcctgagagccgaggacacggctgtgtattactgtgcgagagacggtatggttcggggaatgaacttctacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 439 - DNA, 1359 bp, Artificial Sequence
  TIM3.25 (23B3-VH-G6E-D79Y)IgG1.1 HC (without C-terminal K)
caggtgcagctggtggaatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactgtatctgcaaatgaacagcctgagagccgaggacacggctgtgtattactgtgcgagagacggtatggttcggggaatgaacttctacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaagcagcatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 440 - DNA, 1362 bp, Artificial Sequence
  TIM3.25 (23B3-VH-G6E-D79Y)IgG1.3f HC
caggtgcagctggtggaatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactgtatctgcaaatgaacagcctgagagccgaggacacggctgtgtattactgtgcgagagacggtatggttcggggaatgaacttctacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatga

SEQ ID NO: 441 - DNA, 1359 bp, Artificial Sequence
  TIM3.25 (23B3-VH-G6E-D79Y)IgG1.3f HC (without C-terminal K)
caggtgcagctggtggaatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactgtatctgcaaatgaacagcctgagagccgaggacacggctgtgtattactgtgcgagagacggtatggttcggggaatgaacttctacggtatggacgtctggggccaagggaccacggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaagccgaaggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggttga

SEQ ID NO: 442 - DNA, 645 bp, Artificial Sequence
  14H7 (TIM3.24)LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 443 - DNA, 645 bp, Artificial Sequence
  23B3LC(VK1)
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 444 - DNA, 639 bp, Artificial Sequence
  23B3LC (VK2)
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 445 - DNA, 1470 bp, Artificial Sequence
  14H7hIgG4 HC
caggtgcacctggtggagtctgggggaggcttggtcaagcctggagggtccctgagactctcctgtacagccttcagtgactactacatgagctggatccgccaggctccagggaaggggctggagtggttatcatacattagtaatagtggtagtatcatatactacgcagactctgtgaagggccgattcaccatctccagggacaacgccaagaactcagtgtatctgcaaatgaacagcctgagagccgaggacacggctgtgtattactgtgcgagagggcgaattggtttttttgactactggggcccgggaaccctggtcaccgtctcctcagcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagctgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgctacacgcagaagagcctctccctgtctccgggtaaa

SEQ ID NO: 446 - DNA, 1467 bp, Artificial Sequence
  14H7hIgG4 HC (without C-terminal K)
caggtgcacctggtggagtctgggggaggcttggtcaagcctggagggtccctgagactctcctgtacagccttcagtgactactacatgagctggatccgccaggctccagggaaggggctggagtggttatcatacattagtaatagtggtagtatcatatactacgcagactctgtgaagggccgattcaccatctccagggacaacgccaagaactcagtgtatctgcaaatgaacagcctgagagccgaggacacggctgtgtattactgtgcgagagggcgaattggtttttttgactactggggcccgggaaccctggtcaccgtctcctcagcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagctgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgctacacgcagaagagcctctccctgtctccgggt

SEQ ID NO: 447 - DNA, 1500 bp, Artificial Sequence
  23B3hIgG4 HC
caggtgcagctggtgggatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactggatctgcaaatgaacagcctgagagccgaggacacggctgtgtattactgtgcgagagacggtatggttcggggaatgaacttctacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagctgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgctacacgcagaagagcctctccctgtctccgggtaaa

SEQ ID NO: 448 - DNA, 1497 bp, Artificial Sequence
  23B3hIgG4 HC (without C-terminal K)
caggtgcagctggtgggatctgggggaggcttggtcaagcctggagggtccctgagactctcctgtgcagcctctggattcaccttcagtgactactacatgagctggatccgccaggctccagggaaggggctggaatgggtttcattcattagtggtagtggtagtatcatatactacgcagactctgtgaagggccgattcaccatctccagggacaacgccaagaactcactggatctgcaaatgaacagcctgagagccgaggacacggctgtgtattactgtgcgagagacggtatggttcggggaatgaacttctacggtatggacgtctggggccaagggaccacggtcaccgtctcctcagcttccaccaagggcccatcggtcttccccctggcgccctgctccaggagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagctgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgctacacgcagaagagcctctccctgtctccgggt

What is claimed:

1. A human monoclonal antibody, which binds to human T-cell immunoglobulin and mucin-domain containing-3 (TIM3), comprising a heavy chain variable region (VH) and a light chain variable region (VL), wherein:
   (a) the VH comprises a CDR1, CDR2, and CDR3 comprising the sequences set forth in SEQ ID NOs: 45, 413, and 414, respectively, and the VL comprises a CDR1, CDR2, and CDR3 comprising the sequences set forth in SEQ ID NOs: 64, 66, and 69, respectively;
   (b) the VH comprises a CDR1, CDR2, and CDR3 comprising the sequences set forth in SEQ ID NOs: 45, 415, and 416, respectively, and the VL comprises a CDR1, CDR2, and CDR3 comprising the sequences set forth in SEQ ID NOs: 64, 66, and 68, respectively; or
   (c) the VH comprises a CDR1, CDR2, and CDR3 comprising the sequences set forth in SEQ ID NOs: 45, 415, and 416, respectively, and the VL comprises a CDR1, CDR2, and CDR3 comprising the sequences set forth in SEQ ID NOs: 64, 66, and 419, respectively.

2. The human monoclonal antibody of claim 1, wherein the VH comprises an amino acid sequence which is at least 80% identical to the amino acid sequence set forth in SEQ ID NO: 410 or 411.

3. The human monoclonal antibody of claim 1, wherein the VL comprises an amino acid sequence which is at least 80% identical to the amino acid sequence set forth in SEQ ID NO: 417 or 418.

4. The human monoclonal antibody of claim 2, wherein:
   (a) the VH comprises the sequence set forth in SEQ ID NO: 410, and the VL comprises the sequence set forth in SEQ ID NO: 417,
   (b) the VH comprises the sequence set forth in SEQ ID NO: 411, and the VL comprises the sequence set forth in SEQ ID NO: 418, or
   (c) the VH comprises the sequence set forth in SEQ ID NO: 412, and the VL comprises the sequence set forth in SEQ ID NO: 60.

5. The human monoclonal antibody of claim 1, wherein the antibody is selected from the group consisting of an IgG1, an IgG2, an IgG3, and an IgG4.

6. A human monoclonal antibody, which binds to human TIM3, comprising:
   (a1) a heavy chain comprising the sequence set forth in SEQ ID NO: 386 or 387, and a light chain comprising the sequence set forth in SEQ ID NO: 408;
   (a2) a heavy chain comprising the sequence set forth in SEQ ID NO: 388 or 389, and a light chain comprising the sequence set forth in SEQ ID NO: 408;
   (a3) a heavy chain comprising the sequence set forth in SEQ ID NO: 390 or 391, and a light chain comprising the sequence set forth in SEQ ID NO: 408;
   (a4) a heavy chain comprising the sequence set forth in SEQ ID NO: 392 or 393, and a light chain comprising the sequence set forth in SEQ ID NO: 408;
   (b1) a heavy chain comprising the sequence set forth in SEQ ID NO: 394 or 395, and a light chain comprising the sequence set forth in SEQ ID NO: 29;
   (b2) a heavy chain comprising the sequence set forth in SEQ ID NO: 394 or 395, and a light chain comprising the sequence set forth in SEQ ID NO: 409;
   (b3) a heavy chain comprising the sequence set forth in SEQ ID NO: 396 or 397, and a light chain comprising the sequence set forth in SEQ ID NO: 29;
   (b4) a heavy chain comprising the sequence set forth in SEQ ID NO: 398 or 399, and a light chain comprising the sequence set forth in SEQ ID NO: 29;
   (b5) a heavy chain comprising the sequence set forth in SEQ ID NO: 400 or 401, and a light chain comprising the sequence set forth in SEQ ID NO: 29;
   (b6) a heavy chain comprising the sequence set forth in SEQ ID NO: 402 or 403, and a light chain comprising the sequence set forth in SEQ ID NO: 29;
   (b7) a heavy chain comprising the sequence set forth in SEQ ID NO: 404 or 405, and a light chain comprising the sequence set forth in SEQ ID NO: 29; or
   (b8) a heavy chain comprising the sequence set forth in SEQ ID NO: 406 or 407, and a light chain comprising the sequence set forth in SEQ ID NO: 29.

7. The human monoclonal antibody of claim 1, which has one or more of the following properties:
   (1) binding to membrane bound human TIM3 with an $EC_{50}$ of 1 µg/mL or less as measured by flow cytometry;
   (2) binding to human TIM3-IgV with a $K_D$ of $5\times10^{-8}$ M or less;
   (3) binding to human TIM3-IgV with a $K_D$ of $10^{-7}$ M or less;
   (4) binding to cynomolgus TIM3-ECD with a $K_D$ of $5\times10^{-7}$ M or less;
   (5) binding to human TIM3-ECD with a $K_D$ of $8\times10^8$ M or less; and/or
   (6) inducing or enhancing T cell activation as evidenced by enhanced proliferation of TIM3-expressing T cells.

8. An immunoconjugate comprising the human monoclonal antibody of claim 1 linked to an agent.

9. A composition comprising the human monoclonal antibody of claim 1 and a carrier.

10. A kit comprising the human monoclonal antibody of claim 1 and an instruction for use.

* * * * *

UNITED STATES PATENT AND TRADEMARK OFFICE
CERTIFICATE OF CORRECTION

PATENT NO. : 12,129,297 B2  
APPLICATION NO. : 16/961545  
DATED : October 29, 2024  
INVENTOR(S) : Xiao Min Schebye et al.

Page 1 of 1

It is certified that error appears in the above-identified patent and that said Letters Patent is hereby corrected as shown below:

In the Claims

In Column 230, Claim 7, Line 54, delete "$8 \times 10^8$" and insert -- $8 \times 10^{-8}$ --.

Signed and Sealed this  
Eighth Day of April, 2025

Coke Morgan Stewart  
*Acting Director of the United States Patent and Trademark Office*